United States Patent 10,233,495 (METHODS AND COMPOSITIONS FOR SCREENING AND TREATING DEVELOPMENTAL DISORDERS) - sequence listing, part 25

SEQ ID NO: 206 - DNA, 558595 bp, Homo sapiens
  misc_feature (32748)..(82747): n is a, c, g, or t
  misc_feature (269783)..(319782): n is a, c, g, or t
  misc_feature (355773)..(355872): n is a, c, g, or t
  misc_feature (355887)..(355887): n is a, c, g, or t
  misc_feature (388489)..(388588): n is a, c, g, or t
  misc_feature (389896)..(389896): n is a, c, g, or t
  misc_feature (390558)..(390558): n is a, c, g, or t
  misc_feature (390629)..(390728): n is a, c, g, or t
  misc_feature (393582)..(393681): n is a, c, g, or t
  misc_feature (394351)..(394351): n is a, c, g, or t
  misc_feature (395813)..(395912): n is a, c, g, or t
  misc_feature (441533)..(441632): n is a, c, g, or t
  misc_feature (459577)..(459577): n is a, c, g, or t
  misc_feature (459644)..(459743): n is a, c, g, or t
  misc_feature (485138)..(485138): n is a, c, g, or t
  misc_feature (493226)..(543225): n is a, c, g, or t
  misc_feature (546163)..(546262): n is a, c, g, or t
  misc_feature (548472)..(548571): n is a, c, g, or t
  misc_feature (551953)..(552052): n is a, c, g, or t
  misc_feature (556615)..(556714): n is a, c, g, or t
ctctcaggctcattgttataatcctctcaaggatcagtctcattagcagacagcacagtcttgatcccttgtttcaccaagctatcaacttggctgagagaagttgttgttagtcctaggggaacttctcatatcccttgcaagctcttcaagtatttgtgtattttcccctttcagaaagttgtgtttatctcagcatcccattgtcatctccaaaattaaataattgtgaaggatctaagatttcatcctatttgtaaacaaacctattaacctttcattttcatggatgctggtagaaggcatgagacactgaagcatgaaaaaaatacctacaatttactgtctacctggaggcaaaagactcatatttgtattagttctccgtgtccatactacattttttagagggacttcaaaaggctcagatggacattgcacttggggaaggtttgtgtcacagctgagcagactcaagactaagaaacctcaatcttcttaaagtaggttacatgcaaacctgtccaacctttgcctcacagagaaaaattgtctttattatattgattgagcaatttatctgccattcacctgaagagaaaaactactaccctttttccaggttattcgtgtacaaaaatctttgaaaaatagcctggaacaggacaggtatgtgatgtaagacacaacaaaatgacaaactctaagagacttttacagaactacatctcagtagcatgcatcttttccataaaatgttgcactaaacaatcctgtgatgaaaaaaatccattgaagatatttgacatgaagactaactttggttgttttgtgttgtgggattgttcaagtgattctcctgtgtcagcctccaaagtagctggagtacaggctcccacgaccacactcagcttatttttctatttttagtagaggtggggttttactatgttggtcaggctggtctcgaactcctgatctcaggtggtccgcctgccttggcctcacaaagtgctaggaatataggcatgagccaccatgcccgaccccagaaatgaaagttctatgtgtgcagtaatgtaattctgactgataaatgacaggtgacagtaagtgaaaatctaacacaattcaacatttctacatatttagacacattgtaattggttagcttattggaaaaagttaaatgactaccaatttatacggcatatttattctgaatgaattgctaatctagatttgagagatgaaataattatttttacaacacagaaacataaagtgcatttccatataccaacaatgaacaatttgacagtaaattaataaaacaattgtttgcaacaacattaaaataatataattcttagcaataaatttaataagaaggtacatattttgtacaataaaaaatacaggatcagaatatttatgaaaaaaactaaaaaggacttaaataactggcaacaaattccatgttcctgaacctgaagacttaatgaagttaagatgaaaatactgctacccaaagtagtgtacagatgtactgtaatcccaatttttaatttttccaacttttcttttgcaaaaacaaaataattcatttaaaacttcatatgaaatttgaaaatcctctgaatgtacagaataatcttgaaaagaagaacataattagatatttcacaattttaaatttgaaaacatacaaagctactataacagtttgctagtggcataagaacaattgtagagatcaaataaataaaatagataatccaaaaaacccttgcataaattattgattgtcttttgacaagggtgccttagtcattatgtaaagaaagggacagtttgttccacaataaattctgggaaaacaagttcacatttaaaccagtaaagttgaatctttatcacattccaagtacaaaaattaaataaaaatagattaaagacataagtgttcaactttaatggtttctaatggttgtttttatttatgtggggtcagtattaacatgaacacctttatacacacaaactagaaaactttaaagaaatagatacattactagatatacacactctcccaagattaagccaggaagacaattatttcctgaatggaccaataaaaagctctgatattatataggtaataagtagcttgccaatcaaaaaaatgaaagccctggactttatggatttgcagccaaattctacaaaatgtacaaagaagagcttgtacaattcctacagaaactatccccaaaaattgaggaggatggtctcctcccaaactcattctatgaggacagcatgatcttgacaccaaaatctggcagagacacaacaaaaacacaaaattagccgggcttggtagcagacacctgtagtcccagctacttgggaggctgaggcaggagaatggcatgaacccaggaggcggagcttgcattaagcagagattgcgccagtgcactccagcctgggcaacagagggaaactctgtcaaaaaaaaaaaaaaaagaaagaaagaaaagaaaacttcaggccaatattcttgacaagcatcattacaaaagttttcagaaaaatatttgtaaaccaaatccagcagcacatcaaacaggtaatccgtcattatcaagtaggctgcctccttaggatgcaaggttggtccagcatgtgcaaatcaataaatgtaatacatcacataaacagaactaaaaacaaaaaacagacgattatcccaatagatgcagaaaataataaaagccgtgtataacaaacccacagccaacaatctgttgaatgggcaaaagttgggagcgttttttttttgaaaaccagcacaaggcaagaatgccctctctcaccatttctattcaacatagtattgaaagtcctgaccagggcaatcaggctagagaaagaaatacaaaaagcatccaaataggaagagagaaagccaaactatttctgtttgcagataacataattctatatctagaaaaccctgtagtttcagctacaaagcttctttagttaacaaacaacttcagcgaattttcaagatactaaatcaatgtgcaaagatcactaacatttctctacaccaatgataaccacactgacagcaaaatcagaaaggccatcccattcacaattgccacagaaataataaaatacctggaaatgcagctcaccagggaggtgaaagagctctacaatgagaattacaaaacactgctcaaagaaatcagagaagacacaaacaaatggaaaaccaccccatgctcatggataggaatatccaatatgactaaaatggctatacttcacaaagcaattgacagatttaatgctatttccatcaaactgccaataaaattttttacagagctagaaaaaactattttaaaattcctataggctgggtgcagtggctcacgcctgtaatcccagcactctgggaggccgaggggtgcagatcatgaggtcaggagatcgaaaccatcctggccaacatggtgaaactccttctcaactaaaaatacaaaaaatagctgggcctagtggcaagcgcttgtaatcccagctactcgggaggctgaggcaggagaatccattgaaccagggagtcagaggttgcagtgagctgagattgcaccactgcactgaagcctgatgatagagtgatattccatcaaaaaaaattatatatatgaaaccaaaaaggagcacacatagccaaggcaatcctaagcaaaaaagaacaaagctgcaggcatcaggttgcctggcttcaaattacactacagggctatagtaatgaaaacagcataatactgatacaaaaacagacacatagacaaatggagcagaatagagagcccagaaacaaggctgcacatctatgcccatgtgataattgacaaggccgacaaaaacaagcaatgagaaaaagattatttattcaataagtggtgctggaataattggctggcaatatgtggcagattgaagctggaccctttatttacatcatatacaaaaagaaaatcaactcaagactgattgaagacttaaatgtaaaatctttatgtataaaaactatgaaagacaatccaggcaataccatcctggatataggaaagggcaaagatttcatgatagaaataccaaaagcaatagcaagaaaagcaaaaattaacaggtaggatttaattaaagtaaagagattttgcatagcagaaaaaaaactattaacagagtaaacagaaaaactatggagtggaaaaaaatatttgtaaactatctatctaacaaaggtctaatatctatcatctataaggaaattaaatttacaaaagaaaaacaaccccattaaaaagtgggcaaagacatgaacagttttcgaaagaagacatacatgaggccaacaagtgtatgagaaaaagctcagcatcaatgatagttagagaaatgaaaattaaaaccacaatgaaatgccatctcacactagtcagaatggctatagtcaaacaataaatgctggagaggttgtagagaaaagggaacttatacactgttggtgggagtgtaaattagttcaactgctgtggaaagcagtttggcaattcctcaaagagctaaaagcagaactaacattcaatagttctgctcgcaatcccattactgcgtatatttccagaaaaataggaattattctaccataaagacacatgcatgcaaatgttcactgcagccctattcacaacagcaaatgtgctacgtatacattatggaatactatgtacccataaaaaagaatgagattatgtcttttgtgggaaaatagatgtagctggatactactgtccttagcaaactaacacaggaagagaaaaccaaatatcgcatgttctgacttataagtgggagctaaataataagaatgtatgaacacgaggaggaaaacagtagaccctggggtctatttcaagtaagagggtgggaggagggaaagaagcagaaaagatagccactgggtactgggcttaatacctgggtgatgaaatcatctctacagcaaactcctgtgacatatgtttacctgtgtaacaaaccttcacacatatacccgaacttactgtaaaagtttcaaaaagttaaactttaaaaactcttaggaaaaagcataagcaaaaatcttataactttaaattttgtgatggtttcttgactgtaacaccaaaagcataggccagaaaataaaaaacagataaattggacttgatttaaatgtgaattttttgatatgaaaagcactctgttgttcgtgttttttgatagaaaaaaccccacctctactaaaatttgatacaaaaagcatgaacaagagagtgaaaagacaaccagcaaatgggagaaaagatttgcaaagcatgtaactgattgggtacataaggtaaaatataataagcaggatatataaagaacttctaaaactcaacaacaaaacgaaacaacagcatttataaaagggcagaggacttgtatctacattgggtcaaaaagtctacagaaaaatgctcaacatcaccagtcatgatggacatggataacaaaaccacaacaagttaccactttacatctattagagtggctacataaaaaccaaaacaacaaaaatgaaaaacaacaagtattggcaaggatgtgggggaagtgaaaccctggtgcatggctggtgagaatataaaatgattttttgactgtgaccaatagattggcagtgtatcagaaagttctacatagaattaccatatgtttcacaacaggtggaacagttccatatgttccaattacaggtgtatccaaaataattaaaaacaatgacataagctgcaaactctgcctctgtggattaagtgatccttgtgcctcagtctaccgaatagctgggactacaagcaagcaccacaatgcccagctaatttttgaatttttagtagagatggggttttgccatgtttccatggctggtctcgaactcctgagcttaagtgatctgcctgcctcagcctcccaaagttttgggattacaggtgtgaaccaccatgtctggactctgttattcaatctaagaactgcatgcagaaatgtgttcaggttttaaaattgtattcacttatgcactgatactttcaaagcaaattttatagcagcatcatttacagtaaaaaatttaaaaagaaatccagatatcttctaagagtcaaacagacaaagaaaatatggtatatacacacaacagaatattatttatccttaaaatgaatgtggggggggaggagccaagaaggccgaataggaacagctctgatctacagctctcagtgtgagtgatgcagaagacagttgatttctgcatttccaactgaggtaccaggttcatctcactggtgagtgccagacagtaggtgcaggacagtgggtgcagtgcaacgtgcatgagccgaagcagggcaaggcattgcctcacccgcgaagtgcaaggggtcagggaattccctttcctagtcaaagaaagtggtgacagatggcatctggaaagttgggtcactcccaccctaacactgcgcttttccaatgggcttaaaaaatgtcacaccaggatattatatcctgcacctggctcagagagtcctacgtccatggagcctcactcattgctagcacagcagtctaagatcaaactgcaaggtggcagtgaggttgggggagggacgcctgccattgctaaggcatgagtaggtaaacaaagtagccaggaagcaggaactgggtggagcccaccagagctcaaggaggcctgcctgcctctgtaggctccacctctgggggcagggcacagacaaacaaaaagtcagcagtatcctctgcagacttaaatatccctctctgacagctttgaagagtgtagtggttctcccagctcacagcttgtgatctgagaatggacaaactgcctcctcaagtgggtccttgactcctgagtagcctaactgggaggcaccccccagtagggttggactgaaacctcacacagcctggtactcttctgagacaaaacttccaggggaacgatcaggcagcagcatctgcggttcaccaatatccactgttctgcagtcaccgctgctgatacacaggcaaacagggtctggaatggacttccaataaactccaacagacctgcagctgagggtcctgactgttagaaggaaaactaacaaacagaaaggacatccacaccaaaaacccatctgtacatcaccataatcaaagcccaagttagataaaaccacaaagaagggaaacaagtagagcagaaaaactggaaactctaaaattcagagcacctctcctcctccaaaggaacacagctcctcaccagcaatggaacaaagctggatggagaatgactttgatgagttgagagaagaaggcttcagatgatcaaactactctgagctacaggaggagattcgaaccaatggcaaagaagataaaaactttgaaaaaaaatagatgaatggatcactagaataaccaatgcagagaagtccttaaaggacctgatggagctgaaaaccaaggcacgagaactaagtgatgaatgcagaagcctcagtagccgatgtgatcaactggaagaaaggatatcagtgatggaagacaaaaggaatgaaatgaagcgagaagagaagtttagcaaaaaagaataaaaagaaatgaacaaagcctccaagaaatatgggactacgtaaaaagaccaaatctacgtctgatttgtgtgcctgaaattgacgggtagaatggaaccaaactggaaaacactctgcaggatattatccaggagaacttccccaatctagcaaggcaggccaacattcaaattcagaaaatacgtagaaggcaacaaaggtactcctcgagaatagcaaatccaagacacataattgtcagattcaccaaagttgaaatgaatgaaaaaatgttaagggcagcctgagagaaaggttgggtgacccacaaagggaagcccatcagactaacatctgggggccaatattcaacattcttaaagaaaagaattttcaacccagaatttcatatccagccaaactaagcttcataaatgaagtagaaataaaatactttacagacaggcaaatgctgagagattttgtctccaacaggcctgccctaaaagagctccttaagctggttttttgaaaggatcaaaaaaatgatagaccactagcaagactaataaagaaaaaaagagaagaatcaaatagacacaataaacaatgataaaggggatatcaccaccgatcccatagaaatacaaactaccatcagagaatactacaaacacctctgtgtaaatacactaggaaatcttgaagaaatggataaattcattgacacatacactatcccaagaataaaccaggaagaagttgaatctctgaatagaccaaaaacaggagctgaagttgtggcaataatcaatagcttaccaactaaaaggagtccaggaccagatggattcacagccgaattctaccggaggtacaaggaggaactggtaccattccttctgaaaatattccaatcaatagaaaaagagggaatcctccctaactcattttatgaggctagcatcatcctgataccaaggcctggcagagacacaaccaaaaaagagaattttaaactaatatactcgattaacattgacgcaaaaatcctcaataacatactgacaaactgaatccagcagcacatcaaaaagcttatccatcatgatcaagtgggctttatctctgagatgaaaggctggttcaatatacgcaaatcaataaatataatgcagcatagaaacaaaaccaaagacaaaaaccacatgattatctcaatagatgaagaaaaggcctttgacaaaattcactgacacttcatactaaaaactctcaataaattaggtattgatgggacgtatctcaaaataataagagctatctatgccaaacccacagccaatatcatactgaatgggcaaaaactggaagcattccctttgaaaactggcacaagacagggatgccctctctcaccactcctattcaaaatagtgttggaatttctggccagggcaatcaggcaggagaaggaaataaagggcattcaattaggaaaagaggaagtcaaattgtccctgtttgcagatgacatgattgtatatctagaaaaccccattgtctcagcccaaaatctccttaagctgataagcaaattaagcaatgtctcaggatacaaaatcaatgtacaaaaatcacaagcattcttatacaccaataacagacaaacagagagccacgtcatgagtgaactcccattcacaattgcttcaaagagaatgaaatacctaggaatccaacttacaagggatgtgaaggaactcttcaaggagaaatacaaaccactgctcaatgaaataaaagaggatacaaacaaatgaaagaacattccatactcatgggtaggaatatggaagaatcaatatcgtggaaatggccatactgcccaaggtaatttatagattcaatgccatccccatcgagctactaatgactttcttcacagaattgaaaaaatactactttaaagttcatttggaaccaaaaaagagctggcatcaccaagtcaatcctaagccaaaagaacaaagctgaagtcatcacactaactgacttaaaactatactaaaaggctacagtacccagtaatcaaagcagcattgtactgttaccaaaacagagatgtagaccaatggaacagaacagagccctcagaaataatgccgcatatctacaactatctgatctttgacaaacctgagaaaaacaagaaatggggaaagtattccctatttaataaatggtgctgtgaaaactggctagccatatgtagaaagctgaaactggatcccttccttacaccttatacaaaaatcaattcaagatggattaaagacttacatattagacctaataccataaaaaacctagaagaaaacctaggcaataccattcagcacatagtcatgggcaaggacttcatgtctaaaacaccaaaagcaatggcaacaagagccaaaattgacaaatggagaaactaccatcaaagtgaacaggaaacctgcagaatgggagaaaattttcacaacctactcaactgacaaagggctaatatccagaatctgcaatgaactcaagcaaatcgacaagaaaaaatcaaacaaccccatcaaaaagtgggcgaaggatatgaacagacacttctcaaaaaaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggaatgtaaactagttcaaccattgtggaagtcactgtggcgattcctcaaggatctagaactagaaataccatttgacccagccatcccattactgggtatatacacgaaggattataaatcatgctgctataaagacacatgcacacttatgtttattgcaacactattcacaatagcaaagacttggatccaacctgaatgtccaacatcgatagactggattaagaaaatgtggcacatatacaccatggaatactatgcagccataaaaaatgatgagttcatgtcctttgtagggacatggatgaaactggaaaccatcattctcagcatactagcgcaaggacaaaaaaccaaacactgcatgttctccctcagaggtgggaattgaacaatgagaacacatggacacaggaaggggaacatcacacaccatggactgttgtgggttggggtaaggggcagggatagcattaggagatatacctaatgctaaatgatgagttaatgggtgcagcaaaccaacatggcacatgtatacatatgtaacaaacctgcacgttgtgtacatgtaccctaaaacttaaagtataataataataaaataaaataaaaataaaaaagagaggaagtaagccatgctgattcctgatgagaaagcattccaagcaaaggggaccacacatgcaaaggccctgaggcagaagcacaactgcctggtgtctttgaagattgcaaaatagaggggagactgactggactacacatcagagaagtgtcaggggacaagatggtttaaaacattcctagccatggaaggttttaagcagatgaaaacattattttccttatgctttgaaaagacttactctggatcacctgaggtcaggggttcaagacctgcctggccaacatggcaaaaccacatctctattaaaaacacaaaaattagccaggtttggtggtgcatgcctgtagtcccagctacttgggagcctgaggcaggagaatcacttgaacccaggagttagcggttgtattgaacccagattgcaccactgcactccagcctgggagacagaggagactctgtctcaaaaataaataaataaataaagacttactctggttgctcagtgaagtacaaagtacagggagaaagagaaagtgggagaggagttagaaggctattttcataatccatgaaagcaatgacgtaaagtgaagcagggtgtacacaatgggtgtagcaagggaagctcagattcttaatacagttcaacagtgtatgctgatatgaggtgtaagaaacaaagaggggtcaagacaagttttctggcctaacggctggtacgctggaggtgctatttactgagtcagagaagactgaggagtgttgggcccagaggttgaaggtggaggatcaataattcccttatggatgtgtgatagttgagttgtctattagtcttccaagtggtgataatcggcagataattagatatgagtctaaattttagaggagaggtaggagctggaaatatgtgttcatggaccatgcacatatacatggaatttaatgccattgggcttcatgagatcacagaggcatgagtgcaccaagaaaaacggttgagaacagttaaaaggtaaatgttccttctacattttgaatttatagaaataatgacacagtagccagttgctgaaacactacccagttcagagtaaaacaaatttcctattttatcaaatcattgaatgccatttaaaattcagaatacttgcagagatcccaaatatcttaataaagatgaaagcctaagttcacattggtggcctagactctgccttccctgatcgtctatttaaaaataacaataatgatatggttttaggtctaatgtttaagtctttaatccatcttgaattgatttttgtgtaaggtgtaaggaagggatccagtttcagctttctacatatggctagccagttttcccagcaccatttattaaacagggaatcctttccccattgcttgtttatctcaggtttgtcaaagatcagatagttgtagatatgcagcattatttctgagggttctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttatatcctcttttatttccttgagcagtggtttgtagttctccttgaagaggtccttcacaataatgacaataataagaagaaatattcatggatcactagatatggtgaaatacaatcaaaggaaaattcatttcttttctactatacctttgtaactatcagtctttaaaatagttttattagaaaggcacagtcaccctcacgccaatagcagcttataaatacggggcaaggagcctggtgtggggaggctgagagataattgagagaaccagtagatatgaagctaataaataacactgtcgacgagaatgaggcagataagccagaggcagtgcaaatggccggtcaagacaggtagacagacagaagccaggagtgagagacgggaggtccaaagtgaatccatgggagcttacagcgggggggcggatgaagggaggagcatccaggtagaggggaaggaatggaggtgtgaacaggaggcaggagggcacaagctatttgatatatttggagagcgaggtgctttttttgaggctgagaaaataactggaagccaaaatctggaggactgggtagacaatgttaaacagcaagcacttgattctgcacgtgttggaagccagtgcagggcttctaagcaaggcagtgacatgaccacatcacattttaggaagggtacaaattaggcatgaccacaggcagtaagacccgagagatctcttacagtcagggataagagtctaaacgacaaggtggccatgaacattcaaagaaagaagactgaagagactttagagggcaggccccacgggacctgagtgaaggggtttgggagtctcacagctttcttctgtgaagtcaaggatatcacaaactatcggaatgaaagaaacagtcctagggctaggggtaggtggatgaatgtggttccattttgaacaagaagagaaaattcaggtaattcattttgattgatcaagcaaaataatttgcagctgaacattatagaagcaacaacaattcttatgatactggggtataggaaacaggctcaagaaagcacagtatttcctgtttctcttctgattcaataaataatattttctgttaaggtttttgataagtgttgttttaattaatcaaaaggagacaagataaatttgaacttaaaagcataagaaaatcagttgtctttttagaaaaggtgagtcagtatttcctatggtcttaaatcatccttcaaataatgatctatgaaacaaatgagatcctacttatctagccttttccttgataaattaaaaactgtaccaaaatcttactatattgcaaagacactagttcactcaattgagaatcctcagtatacaaacatataaatcaagggaacttaaccaatcattgtgttcaaaatgggaagattattccaaattttttctacatattttagaataatttcacagttaaacaccctgtagcttataaaatcattatccagtatttaataaagtatatctataacaatatcaacattttaatttaagagtttacaaagcacttttgatacatcacatttaaatgaaggcggcaacgagttcagtacattcatgcagattagaaaacagtagtttttgaagattgtattttttcatgtaagtcagaaggtttgaactatttcctactcctgctatgggtttaagcctaagaaacgttattcattatgatttggtctttaaataaatcacgaaggtagagagtagagcacaccccatgaatgcactgaggtgccgtaagtctccaacgccagaggtggcaggttggaatttagttcaatcacgaatttgttatgagaactctgacaaccttcagctctaaagtaagcttggaaacacaaagaaactctgcgaaaaatactgaacacagacacacacacacacactcctctcttttaagactggcataaaagatgtaagtgtaccaacaagcaacctccaaagagcaaatgaaacagaaaattcaaacgagtgcctggtaggagttgtaacttcaacaaagtgcctctcatatctgcctcataaacccgtactcatttttcacaactaactcacatagcaccccctcagtgacacctttcctgttctgcctaccagatatatctgcagacctagggtatcttctcgtccagaacacagggcatctcatacagggggctctatctacagggggctctatgctttgacaggaactgtgaacctatgggcagcagttttttcaattcatgtttgtggctctcattacaaatgtcctgcctcaggcacccagcaggtggtaataaatgctggttgaacattaaaaccttggaatgctgtatcattattctaaaggatagacattttttaaaacattttggaagttcttttgaaactgactttttagattatgaaaatatctcagtgataggttttgattttccaagttagaccttattttattttagaaaccgtcaaagttatacaaaaccaagcatgtgtctctgtgcattttgttttctctcctcccttaatggtaaggaaggatttcatctcttttataggccaaatgctccacaaatgaatgtgttaacaaatgaacaaattaataaatgacatgaatgagagctcaaactgcataaaagtatacttacttaaacatgagatgtgacgattgctaacatgtcataatcagactctgtcctgacttcagcaaaccacaactttgacaacaaagaggaaagaggatcaagtccctaaataccgcaggtgcactaagaccttcccacgtgcccgaagaagatacacttgcagaggagaaacgatgatgcagaggcctgctccgagatgcaggaggaagtttaattgcctgtgaatttgactggaatggcagtcaaacgaggtttgaaaggaaatagagattgttaaactactgactaggcgataactgccgtccttctcttctatctgtccctgttactaggcaataactgccttccttctcttctatctgcccctgtgactaggcgataactgccgtccttctcttctatctgcccctgtgactaggcgataactgccctccttctcttctatctgtccctgtgattaggcgataactgccctccttctcttctatctgcccctaccttgggccccaaatgactcagcactaaagtgccttgagcaggctccagcccaaaagtggcctccacgggcagcacttctcgctctgctgccctgccttgctttcctcctggcaggtaagaaagaaggaaggaaagaagaccctgaactggaatcatacacatcatcgcaattcatccacaccgcagtcctttaaggtttgtgccattgtactcagaaaactgaggctcaaagagattgagcaacttatctaagacctcacaggtcctgagagcagagtctggatttcaaacacctgggagactctgaaatccatgttagctcttctatacatgggcccaaaatgcagctgtacaccagcaagactgacttcctcttgcggcttatcactagctctgaatacaagaatcttcaaaatgctttataaacaatagtagcatcatgggaataagttggcaagttcccagaattactgttttagatgcacttgaactttttctccatgtatagagtcaggaataaggaaaaaggatccaaaggagaaggagaaaaataaaacgggactgagccttatacttcttgaccagaactgataatgttgggattttccttactttttttccagacaaatccaataaagacgtctgtttctgttacctaaaacctacttgaaaagtttgctccctcccaccttaagcggctttgtatagagcccacagttgaacattggttccaacgacaaaggttaatttcaaagtttttatagtattattcaaagcacgtttgatttcagccttggcaaccatgggcagaatgtcagcaatgctccctctattagctattggagagaaaacactgtgaaactctaagaccttggttattgggctaatgaaacatttatgccctgatcagatggagcaaaacttcggcagggttagtgagccaccttccaagtgtaccaatgaagctcttgcctgctgttacagataaatgactttcatttcactattggcttgtgcttgagaaggttattcaattgattccagttgtttgcaatgccttgaaggcaaataattttgtagcatccactgtcctcagaaaaaatacactgtttcttttctaaggaaggttgttttcataataccctagatatcaacagaaaatattccacttcttatcatatattaatttggctctggaataagtaaatgtaactaccagaatgctaattaggatgttacgctgatgtttatttgtgtgttctaatctgtagataaacaacaaggtctcttataattcatgattccaagtctcaggccacagcaggacaagtatcaaaacatctattctcaatttggagttgagatttctaaaaagaattctattttatccataatcataaaatagcaccaggaaaagtcaatatcttaaaatacagatcgttgaaaagtagatctttctgcccttaacataaacaaactgtaaaatctgaagttaaaattattccttgtaccagcctcctagtttacccagatttaccagaaaagttatagcagtgcatgaagctctgaggttttgatgggtgtagatatagacatccaattctgccatttcacactagtcagaataccagtcatagaaatcccacaggaaaaatcatttctgaaggtatctggtcttatggattataaaattaaactttcttatcattttacctaaaccgaaatatgcttcctatacaaagaagatttctttcaagagttaagaccacctcccgccatcccccttaacacacacacactcacacacacacagagatagagagagagagagagagaaagaaaattgagagcattagtggttttcttccttagactgattttttcttgctgttattttcagccactttgttaacggtggagttaaagggcaggatagatgtaacacccatttaacatacatgttgcaacatcagagatgctagtcttcattaaaaataccagttctaaattccttctaaaatatatttttaaaaatcagtacccttggtaccttggaaatgctgaaatgttatcatgaattctgtttatttgttatgagtctactgaatattatcttcaatataaactataatttactggtctgaacactcttcctatcttacctgtatatactctaagggagcaatttctcatgtttagcaaattgttctttaggtaatttgttctttagtttttttgtacaaaagtacaaaataattatcacaacaaattttccagtatttattattttgaagctatatattttggagtgaacttgttttttttttttccatgtcaggcttgagcaggatagcaaatatataaattgagctctctaattataatctcaatatatgaattcttgctaattaaaatactttgcacaagcaaaaacaattgccacgtatgtgtttaggaggtagttaagtaactctatataaaaataagtgcactttcccctcctttcttcagtgactagagaacttccatacttttaaaataatcaaataataatttagagagaaacagccctcaactctttgctggtgcttatcacactgcctttcttcactccattcttagctctgctagtttcttcttgtctgtaatgataataagggaatgtgggtgggtcagcacttctgtgtaggtcccctttccaaatttgccttccaaaaagccaaccaaataaacaaccaaaaaattgtgcaacaaaacacaaatagcattccaacatcttggtaagtgatgcattcacctgagattgagtggttttaggcggtcagtaacaaaatgtttctttgctgtcttagtagaaaggcaacaaattcttcaaagaaaccaagaaggttactaccttgacaacgtctctcattaccttcctcctcttatgtcttttctctccacattatctgttgtgtatctactatagaaggctacaaaacatacagcagaaaggatggcttgaaggcaattgatgtttgtaaataaattcacaacaaggtccaagctgaagaggtgaacacatcagccgggtgggacaattctcagcatgtgcaaacataggcaaattctagcctatgttacattgaaaacaatgtcagtgcattttttcaatgttaaagattttttcaaagctaaagcgtgttctttgctgtgctgaccacaaacaagtttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttttagtagagacggggtttcaccgttttagccgggatggtctcgatctcctgacctcgtgatccgcccgcctcagtctcccaaagtgctgggattacaggcgtgagccaccgcgcccggcccacaaacaagttttaagagtttcggaagtctggcaaaaatagaaaaaaaaaaaagctgaagcaacattgaaccgcacaatgtaagcattgggcatgcacaaattttcaaaacaaaggaaggaaatcatccctctctacaacgtggttaggctgatttttaagaaataaaatgtaagaaatcagaaaagcaaatgtttggcacctacatatccaatatctggcaccgtgcagagtagaagagtgaaagaaataatgaagaacaaagtggttactttgcttcaggagttcatgatctatagttagaaaccaatataaacattttgagtatatttcaaagaaagagaaaagcaggccgggtgtggtggcttgcacctctagtaataacagtttgggaggttgaggtgggaagattgcttgagctcatgaatttgataccagcctgagaaatatagtaaaacctcatatctataaaaagttttaaaaaaaggagagcaaaaacaaatacgaaagaaaacattagaaatcagagctcgggcaaagagttcaacgtgagcaaagcagctctgccctgggggacctctggagcatcccggcttcctgtagaggccccaccacatggccctttcccatcactgggaaccatcttctgtatcatgccaggaatttcccccaaacttctcaacctaatttattcagccaaaccatatatatttcttgaatccttactaaaagcaaggcactgttcaacttaatgaaaatatgtcaactatataaaacaaaaatgtttaccctcatgcaagttatattccagtgagaaaagacagatcattaataaaataaatatgtaaaatatatgatatgccagaaggtaataagtggcacagagaaaaattaagtttggaagagagctcaggaatgctgggagcaggtagatgtgaaggtagttagaatgctcaaggagggagtaataggcagaagaatggcctttctacatgtccatatccctatatggcaaaaaggacttatggatgtgatgaagttatggatcaggagatgaggagattattctggattacccatgttggccaatgtcatcacaagaggacttaaaagcaaaagagggaggcaggagagtctgaggcaagaagcgtgacagctagggtcagaatgatgtggttgttgcctggaagggggccagggtccaagggatgcaggcatcctttcaaagctggagaaggtaagaaagtgttctctctcccctagagagagtgtgtgttcttttaggctactagaggtgtgctaatttattccagcagtcatagaaaacttatatagataaggtctcactgagaagataacatttgaacaaagattccaaggaggtgagggcaccagctatgcagatatctggggaagagcactcgaggaagaaaaggcaggcaaacagcagggtgactagcccatgtgcatgaagtagagaacactgggagtcagaaggctaacaggagacaagtcagagagagggactggggtgggtcaactcacactcagcctcactggctattgtaagaacttcgagttattctgacacactcagtataggagagtctatgaatatttatagaaattctgaacgtttacaagatgaataaaagttgtatgctagcaaacctattggttgggtggggggaagcccagatttgtagcatttgctgatttccattgtgtaaatatttctactgatggtttgacaaacacttcataaaatttctgggtacttaattatcagctccagtagagcgctgtatgtatgacaccatatttgccaattccacattagattctattgtgaacaagctgtatgagagtcaactggtggcagaaataaggaagtcctcaataaaaatcagcatttacttttgacagatgtgagattctggaacttatttctctttacttgctctgcctggtgattaaattatgattttaaaagaaatagttttaatttcttatcagaatgctgccaccaaataaataaaatatgtactttaactatatacaatcttgtctatattatactcttgtcaacagaaacattatcatgggccaacttcatgaaaggagatatgtgatagaagatggagttgttggaatggaaaaaaaaagtcaaattttactatggattaatcagagggaagaaagcaaacagataggaaaggaaaggcagacttagccaagtcgaagaggctgaactcaggaggcagtgggagaataggatcatagtttgaagagagctgcgaggctgtttagtccaggtgaggatcataatcccagaagacccagtcacaaacaccataacactgaatgttgaaatcctgaaagattaaaattcctaaggtctaaattctcttttttttaatagagatatagtgaatgggttcattttcatgctccaaataaaaacatacacgagcctgggtaatttataaaagaaagaggtttgattgactcacagttcagcatggctgggaaggcttcagaaaacttacaatcatggtgaatgcaaacaagaagcaaggcaccaggaggtgctgagcaaaaggggaaaagccccttataaaaccttcaggtatcactcactgtcatgagaacagcacgggggtaaccacccccatgattcaattacctccaactgggttcctcccataatatgtagggattatggaaactacatttcaaggtgagatttgggtggggacacagccaaaccatatcattctgccctcagccccttccaaatttcatgtccttacattttaaaacatgatcatgcctttctaacagtcccccaaagcctcagctcattccagcattaacccaaatatccaagtccaaagtcttatcttagacaaggcaaggcccttctgcctatgagcctgtaaagtcaaaattaagttagttacttcatagatacaatgaggatataggggtcagtcaaatcttgaagctctgaaatgatttcctttgacttcatgtctcacatccaggtcacgctgaagcaagaggtgggctctcatggccttggacagctccacccctattgctttgaagagtacagccctcctcctggctgctttcacaggatggtgctgagtgtctgtggcttttccaggcaatacagtgtaagctgtcagtgtatctaccattctggagtctggaggatggtggccgtcttctctcagctccactaggcagtgccccagtggggactgtgtgggggctctgaccccacatttcccttctgcactcactgccctagcagaggttccccatgagggtaccgtccccatcacaaatttgtgcctgaacacccaggcgtttccaggcatcctctgaaatttaggtgtagatacccaaacctcaattcttgacttctgtgcacccacaggcccaacgcctcatgtaagctgccaaggcttgggccttgtaccctctgaagccatggcctgagctgtacattggccctttaaccatgattgggacacagggcgccaagtcctgagactgcacagagcagcaagtccctgcaccgggtccattaaaccatttttttcctcgtagccctcctggcctgtgaaggtttgagttgctgtgaaggtctctgacatgccctgaagacattttcccattgtcttggtgattaatatttagctcctcgttacttatgcaaatttctgcagctggcttgaatttctctccagaaaatgggttttccttttctatctcataatcaagctgcaaaatttttaaaagttttatgctttgcttcctcttgaacactttgctacttaggaatttattctgccagataccctaaaccatgtctctcaagtttaaagttccacagatttctagggcaggggcaaaatgccatcagtctctttgcatagcaagagtcatctttactccagttcccaacaagttcttcatctccatatgagaccacctcagcctggacttcattgtccatgtcattatcagcattttcctcaaaacaattctgcaagtctctaggaagttccaaacttcctcacatttttctctcttcttccgaaccctgcaaactgttcaaactctgcctgttacccagttccaaattcacttccacatttttaggtatccttatagcaacaccctactacctcagtacacatttactgtatcagtccattctcatgctgctaataaagacataaccaagcttgggtaatttataaagtaaagaggtttaattgactcacagttcatcatagctggggaggcctcaggaaacttacaagcatggtagaatgcaaaggggaagcaagtcaccttcttcatgaggtggcaggaaggagaagcacaagcaaagggggaaaagctccttataaaaccatcagatcttgtgagaactcactatcatgagaacagcatgggggtaactgcctccatgattcaattacctcccactgggtccccatcatgatatgtgaggattatgggaactacaattcaagatgagatttggttggagacacagccaaaccatatcatggggtctcaatttattgccccggctgatttcaaactcctgggctcaagtgatcctcctgacttggcctcccaaagtgctgggaatacaggcatgagccaccatgcccagtcctaaagtctaaattattaacatctaaaatccagaaaatcacaatcacaggagagttgtaccaagttagttgcatcgtgttaggtacaactgttgctttgttttctttttatttggaaattatgtatggtttaaggaggtccatatgggtgtcaaatctgcaagggatggacttgcaggcttaatttcaggtgtcaacttgactggattaaggaatccctggaaagctgggaaagcattattttgggtatgtctgtgatggatttctcagaagagatcagtgtgtgggtctgagcggactaggtggggaagatctgctatcactgttttgaatgtcctgaatatcacagaagaagttaaaatgaaagtaaaaaatgcacaaaatcttgtctgccaaattatgtaatcatgtaccaaacacctctacaggtagcatcatgcttgccttcacaaaatgccttttgtgagataataaaaatacttcaaaaaattcagtggtcttctgagccagacacctcctggcacagagcttcctccagtgctacaagacatattaaatcatgaactattcttgattagggatttgactgtcaaaaaagataaatatgtttatttaccactaaatttaacataacaaaactggtgcctgtttcactttggctgatgaacggcactttcaaaactgtccccagtgggttttttaaatcaactttatacagtttatgccccaattggattacaaaattctgtaatttaatctgcatgtttatggtttaataactggaaaaagtgaagtactttttaaaagcttatttgaagatttggagggctttgcagaagaaaatagatttcaattggatcaccaaattataatgacaagtttttaattaggtgtgatcaaggcttctaaaagtgaaatgcaagttgttaccagtaaactttatatcttccattcagcccagctcatttgccagaaaattcaggtgagtggattgaccaggccatctggcaatgatgaaaattttagtttaaaaatgtgtcatttgtctgtattggcattccttccacctgataaaattccaggagcttttgataaattaaaaccacaattgcctgaagaagacagaaatattacatactggtttgaaaataatgatgtgcaaggtgggataagaagtcatttaggcaacggtgttgctgttcaaccaagagtattgtttctgccaaatgagtggcctgtatatgagggcctgcaaaatggatttcctcatactcaaaacaatagacaagaatggcatagaagattggaaaatataataggaaatgctcatgtcagtgtgtatcaaattatagaagaatttcaaaaagagcagtgccacgtagaaaatgaatgtgaatgtattttatgaggagagtcaaatcctaaaaacaaaaaaggcaactattcatcgtgatgcatgacttcaaaatatagctaatgatcatgaaagtcagccatctatgatgaactctgcaattgcccataatctatccatgtaatatactttttatgtgtcaattttctttttagttgtttctttttccattttttccactattttaaattgtcagcattattttttacaagttgctatgctgtgtatttcatcttagtatcatttccaatactggaggtataaattttgcaaagacttttagagagttctaatttgttttatgcgttttttttttttttgcaaatttaactccacaagagtgcattatcacaacactgactttatgtgtaagcattgtacatgtacataaaaacattaaagtttcctcaataagtgagaagatatcctttttgcacatttgcatttgggaaagagaaaattcctcaggatctcagctctttgactgcatattagatggtgacccatcccagcttttgatgaatctggtcaaaagacttaggttgtctgtcacaatattccagatgacctaagttataaagctgagtgcacccagttaccaaccatgcttttatacattttgctttttgacccatttctttacaactcatctgctcattaccattatacccgtgagactatcattagcatatctgagttttatgcttgcaaatatacgtatgttattattgcctattgattgtgtaaagtggcctaggaagcgttccgttgtgtttttatacgtttctcaaataaattccatcttaaaaatataaataaatgcttttttgttgttgtttttagacagagtctcactctgtcgcccaggctggagtgcagtgttgcgatcgcggctcactgtaacctccacctcctgggttcaagcgattctcctgcctcagcctcccgagtagctgggactacaggcacccgtcacgatgcctggctaattttttgtatttttagtaaagatggggtttcaccgtgtcagccaggatggtctccatctcttgaatttgtgatccacccacctcagcctccaaaagtgctgggattaaaggcatgagccaccatgtgctgcccaataaatgctttttaaagaatgtgttaataatttttttccagaattgtatgttcagaattttgtttttttaggattgtaattttcaggattttagactgtacagatttagatcttttgggacttcaacatatgggattacgacgtttaggattgtgttttcctgggctgtggcccaaactcgtgtggtccaacactatttcacatgagaggaaagcaaaccacgtgcacagatgcaatgaaggcttaaataagcgtcatgtatagattatatcccaggaaaacatgattaagatgatacatagcgacttttttttccccagtgaaaaagatccacattctttttcttgtgtggaattaaacacaatttctgaatcaatgtaagtgaatgcaaatcaccacgttcacttagctgatgctcctttattaacagggatagaaaggaggtcattcgaagagatgatggcatgggacccaggacctgaggaagctgcagtgggtgaaggggagaaacagaggagcaggggctggagaaagagtggggagtcatcaaccaccctcctttctcctggcatctggtgttcggagcccagaggtcttctctagggcctcggagaagcttccaagtctgttcatttatctttccccacccctgcttgtatcacaaataaagaaattattgacaactgagttcctgactaggtggcaggattttagggacccttcacctcgtctgaaactcatgaaggtagtgggaatcccatgggttagttagtaacagtccctgagattatttggtcatataaataatcagaaaactcatagtcatcttgcttttctcataatgcccagctgggggatgttgggggtagggaggactggagtgagaagagacagaaccagagctggctttcatgtatggggctctccagagcaatcaggcctaagtacaaccaagaagggtcttgaagccactctggcaagggcagcctggtctcagaccccagctcacaccaagcacgtcacctgtccgactggaaagcttaaacaatgtgtttctgtttttgcttttgttttctggtaaagaattcaatgccattagctacattcacaatgctgtgcaatcatcaccgctatccatttctgaaacattctatcatcccagacaggaactctgtgcccattagacattaaccccgcccatttccacctcctgccagtcctgaaaacctctattctactttttgtctctattaatttgcctgttccaggttcttcatatagatggaatcacgtagtctgtgtttgacgtctcacttagcataatgtttttaagttttatctatgtggtagcaagtatcagaattccctccctttttaaagatcactaatattccattttatgtctataccacattttgtttatcaatctatccctcaatagactttttaggttgtttccaccttgtggttcctgtaaataaggctgctgtgatgctgcaatgaacacaggtgtagcaggcaggtgtggtggcatgtgcctgtagttcctgctactaaggcatctgaggcaggaagattgcttgagctcaggagtcctgggctgcagtgtgctgtgttgatcagatgtctgcacgaaattagacattagtacagtgacctcctgggataagggactaccaggttgcctaaggaggggcgaaccggcctgggttggagacaaagcagggaacaactcccagtttgaccagcagggggtcatgcctgtggacagcgacgcagcagggagatcctgcccgtggacagccccgcaacagggagatcgtgcccttggacagccctgcagcatggggatcgtgcctgtaaacagccccgcagcagggtgtcatgcctgtggacagcccctcagcaggggttcgtgcctgtggacagccccacagcagggaggttgtgcctgtggatggccccgcagcaggggatcgtgcctgtggacagctccccagcagggggatcatgcctataaacagcccctgcactccaggctgggaaacagaatgagaccctatttatttaaaaaaaaaggggggggtggggtggggagagaacacaggtgcacaagtatctattggagtaactgctttccattcttttgaagatagatataggtagataaagatacagatatagagatttatagatgtgagtgggattactgaatcatatggtattgatgactgtaggcagctcagggcgcatcctcggccccggtgctgtctttcccagagctctgtttaattccatcaggcacgggcagcatttggagaaagctgtgttgatttttgtgatcttcagccagcacagaagtggccagttccctagcctcccagcacggtccttctcctgccctgccccttcatggcctgcctgggctcactggacccagacttgcctttcacccctgtcaaataaggggtgcctttggtagggaaaggcagacgacaccaaataagactggttggagaggggatgagaagcgtcaattagaaagctcttcaaattcaaacggactgttcaaaccatcctaggactagactccaatcgggaaagactctgaaggaaatgatctcctactcccatgagatggctaacgtgatttaggtaaaaagcttttagttttatggctggggaggtagcaataaagaaaatgaacctcctgccagtaattctttttcaagctctgccaattcctgtgtctggggaagctataaagaatgtccagcctcatatcaaaagaattgccacagatctccagctcacctgcattcaagcattgaaacatccctaagcctgttcccaggccagcctggaactgagaatccaggagagtcttttctgttctgctgctgcagctacactatctacttcttagcataaccagggccaccagcaacacatgctagagaaatacagagagcaaaaatcaacagctgatgaaaagcagaatcttttctttttgacagcaataccaacagcatgaagcacgtcctttttggagctttccaaaccaattcaaaagcgagttttctggcgtggatgaagaaagctagccaaattgcccctgaatgcatagccactggccaagatattgatgactgtaggcagctcagggcgcatcctcggccccggtgctgtctttctcagagctctgtttaattccatcaggcacgggcagcatttgtagaaagctgtgttgatttttgtgatcttcagccagcacagaagtggacagttccctagcctcccagcaccgtccttctcctgccctgccccttcatggcctgcctgggctcactggacccagacttgcctttcacccctgtcaaaacctcacagtcctgtgtgtctgtttccctttgaactacacaaactaaccaatttggtgaacctattaagtgaacttttttatactcatggtctagagtgcattgaacgctaaagggtttgctagaggttgtcacaattaattctgtcttcttccaactggaccaaggcttctttgagttaataaaactctgagaaatctgagtggatttttcatagtatctctttctagtcttttggggtttttttgttgttttttacttttcatggagattttccttaatttaacccaaaagatatacccatatgacatttgaactaatatgaaagaggtagtaggacaaataatttggagacagtctttcagagccccacaaagtacttgaaatttatcaataaacccctcccggtgcttcccaccatgttccacattccatctccattttaagccatgaagcttcaagtggcatctcctcctgtgaaacctacagtttggaggtaaattattgatgactaatgacttagaataaccaaagaaaggatcatctagtggagacacagcatggaaatggtggtccagggtgagacggaacttattccaatcccagtgccacctatgtggttccagctgtgtgcttcccttcctctaatcttgtttactcatctctaatacgggactaataacatatacatcagactattgtgagggttgaatgtaacgatattccaaattgttgcatgtgtccagtacttaacatggttccaagaacaaaacatgtatcaataagtatgaatagccttcccagtgcacatctccaaacagtggatttctggccgatgacaagtagtggttcccagcggtcctacaggttatggtttaacttaccactagccaatcagtaagtttgcctcagaccacatcacaattcttttgcaagcctggagcttggtgaaaaacaaggggggaaataatcaatgtccctaaggcagatgctgaaagattaacctcataacataattctctcaccagacttgtttcctgaatgtctatttaaattttaacactgcaaataaaataaagttggtaatgaaggtgattaagatggtatttgtccagggaacgaatctcctcacaacatacctaagaaagagatatatgtacagaaaacgaagcacagtaaaatatcacttcattactatcggagattttccccaaacacagagaaagctctacagagctgagcttaagccagaactctgttatttacttggtgtaatgccaaaacaggccagagacccctttcacctacttctctttaatcccaaacccatgtctctctttgatctaagaaagagccaaacgcccaggaggcgccagggtagagaaaagcagccagccggagagcggcctccgggccaggggagtgtgtctgagctttgttttatttttcttatttgtctgtagttgtgtgattggtagaagagagtagatatgaagtctactgacacaggattggtcttcaagcatgtcttaccaagcatttgggggaacagaggggttccacaaataagagagcaatgatcagacttccttctaaaaggagcagccacaagctaccttaactctccaacttgcccattaatcttcacctagagttaggaagatttcaccattagctgtggcccataaaagatccttaagcttgaccaaccacagaggtccatctccttgaggaggaagtgaaaggggtatggacagaagctgtgagctttctgtcctccgcaggccgccagctatgtcttctacttattgtacaagatagtctctaagtgatgttttctggctgacaatgccacataactgatccttatctcactatggaaatgaaagatttcaaagaatttgttgcctgaaatatggtgccctaatcatatattaataaagctgctatccagaaagaaggcagatttcaaaagaaaggttgttagcattctcaggtacctaaaaagtatatattgtagaacaatggtaagtagatcttggaatccggtagactttaattcaaaccccagctatgccacttattaacttatgtgacattgggaaagcctctcaaatttagatttgcaaaatcagaataatgtaagtagccaacaaatagggtttaatggaggtaataatgaaggttattaagatgataaaattaaacagtgaatataaagtccttagcatttaataaatttattgtatgatttcaaagcacatgcttttacctacagtgctataaagctgcttgcaatagtcaaagttaatagacgctctcgtcagagctaatagaagccttgtatatgtaattatttaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggttgataggtttttaagaattcttttatgacttcaaaagtgtcacttcgtttcttgcttgcatggtttctgatatgaagtcagctcccattcttaaccttgtttcttgtttgataatgtctttttgcctctagcttcctcaagatgtttctcttttgagaaaaatgagagattttcagtttttgtgttgatttctctttgtctctggttttcagctatttgaacacattccatatcactttaagatttcttcatcgggggtcactggacacatgtgtcacaattaacaaaggggaacacattctccaaatgtgttctgtttccccaggaagacagctggaaatgcaacaaaatgcctctccctctcctttagcaaaacacgagtcagggcaatgcaagatttgattgggactgctttacttcattaactattacagtgcgctgtttttctttctagtaacaacccagtaatagttattaaattatttggagctaaataagtgtaatggtaattttcatttaaagtttgctatatggtagcttagagcatcttacctgtacacagttccaaacgcagaaaacctaaatgaaattaacatatatgtatcattacaggttctcaaaacctcataaatggctctattttacatctctgagctcttatatgatgtttcctttaactatgtcacaagacctaagactatggtttgaaatatatacctactataaaaaagtaagccttcctgctggtgtcaatagataaaaacaaaacagacaaaacgacaaccaaaaatgcccagaaatccttttttttttttttttttttttgagatggagtctcactctgtcacccaggctggagtgcagtggcgcgatctcagctcactgcaacctccgcctcccaggttcaagcagttctcctacctcagcctcctgagtagctgggactacaagcgcccaccaccatgcctggctattttttttgtgtatttttatagatacagggtttcactgtgttagccaggatggtctcgatctcctgatctcgtgatctgcccacctcggcctcccaaagtgctggaaaccctgtttttaaatgcatatttgcattcataataacccgtgaatacatacatctattgatctatgtattcatgcatctctatatgtaaatgtctgtccaaaatgccactatatatatatttatatattaaacttttattttaagtttgggttacatgtgcaggtttgttatataggtaaacgcgtgtcataggggtttgttgtacagattatttcatcactcaggtattaagcctagtaaccaatagttattttttgtacccctttccctcctcccaccctccactctcaggtaggccccagtgtatgtcgttcccctctatgtatccatgtgttctcatcgtttaactcccacttgtaggtgagaagatgcggtattttgttttcagttcctgtgttagtttgctaaggataatggcctccagcttcatcatgttcctgaaaaggacatgatctcattcttttttatagttgcatagtattccactattccacggtgtatatgtaccacaatatgttcaattttagtttattacaacttatatgcaacatacaatggcaagatgaatcagatcagaagataaacaattgagtgtgaaaagacagcagtttttttcctgttttattctctgcagatgtaattttcaacgagaatacattttattgcattagtagtgcttttagaagagacatcaatatgatgcccaggctggtcttgaactcctggtcttaagtgatgctccctcctaagcttcccaaagtggtaaattgtacttcctgagggcatagaaaagagacatagaagcaagtgaaattggtattacccttttttctgttattctttattagtaaaacaaattaggtttttctttccttggttttcatgtgtccaagctcctttctctttcatttcacatgtgcacaaatataataacatacacttttgaacatcaaaagttgaatgatgaaagatcattcgttagcccaaatcaacctgcacatgactttttttttattcctctgagagttagcctgtggaaaggtggcagggtttcattgcattatcccctgcagatggaaaggtcaatgacaacatgtgtaattgcttcagtcctgattttctacctacacttactgctgtggggttgtttcacctgaccaaggcagtttctgtggcagcaggtcctagctgtctcgaccaggtccactgacaaagccactttgctgagtggccaatttgctgatgactattttgttaaatttgtttctgctaactatttaaggttgactcattttcttgtgtcatagtctcagcaaatgtgaagggatggctggtctatctctgacctggctttctgctttgacagatggaagctaaaagaaaaaaggaaaaactgatggtgcaaaagataaacatatttatatgagtttattcttgaataaaatgatttatttttaaaatatattcttgatatgatttggctgtgtccccacccaaatctcatcttaacttgtggttcccataatccccatgtgttgtgggaaggacccagtgggaggtaattgaatcatggggacggttacttccatgctgctgttctcataatagtgagtgagttctcgcgagaactgatggttttataaggggcttttcccccatttgctcagcacttctcctttctgccatcatgtgaaggaggacatgtttgcttccccttctgccatgattttaagtttcctgaggcctccccagccatgctgaactgtgagtcaattaaaactcccttttacaaattaccgagtctcgagtatgcctttattagcagcgtgagaacggactaatacgattcttccgatgaatatattcttctcattcataaatgcttgatgtaaatgcttaatttttcctctaggtgccttcaagatttttctcattgtctgtggttttcagcaatttggataccttacatatcgtttttatgaatcttccacagagatcagtggacacatgtggcacaaagaacatgtgaattaagaatgcactcctgaataatatattttacatatatgttattgagcatattcttaaatataaataatttcttgtgaatatattttgattaataaaaatatattaataaatgttaactcatgcatattcttcttactcaaaaatatgttcttatattaattactccctctctcttcctcctagtctccaaaggtaacatcaggggctagaacagagacacagaaatgttccttaaaatgtcaaaatgaaatattgtctattaaaacagaagaattaaaataaacaagagaagttaggtattggtcatctgatatttgtaacctgcagctttcccaggaaacttggttggacccttttcttgattcagctgtcagaagctaaatgttcccttcctctctctctttgcagtctgttcatgacatttggtattcctaatatgcccacttggaggaaattgccagcttaggccaaccagggtgaaatgcatgcacttataaactcataagcccaataataattttcagaaggaggcactcattcacttcggcttataaacttgcaaatctgtagattcattagtctatcacttacatggaaagacaaaatttatatttaattgttgagacttgacttcaaaattttcaagaatatcaacatttgtttttgttgtgcacctctctgtcaaaagataaatacgtagtacataatcattattatttattaataatatactctgcatggtcttacatttcacagttcatgcattgtttattcattaatataacctgttaacgttaatatgcaccacattaccgagagcccttgtcaactcctcagaagcaactaactcccaaggtaactatgacaacgaatctcttaatgcttaaagtgtaacaaaaagattgtgtgatttggatgttaattcaaatatttcctatacagccccatacagccactttagaagggaagtggtttctcacaaaactaagtatattgtcaccataagatccagtaattgtgtcttggcatttaaccaaaggtatggaaaactgaggtcaacacaaaaatctgcacattgatgtttataggagttttattcataattgcccaaaggtggaagcaacttcagtaagtgaatggataaacaaactctggtacactcatacaatagaatgttattaagtgataaaaaggtacacactatttaactatgagtagacatggaaaaaaaaaaccttaaatgcccatcgctaagtgaaagaagccgatctgaaaagagtacatactgtgtaagccgaactatatgacattctttaaaaggcagaacgatgaagacaatgaaaagcacagttgttgccagggatttgcagggagaaggagggatgaataggtggaacacaggggatttttagggcagtgaaaccattctgtaaaatgtcatggtggatatatgacattacacattttccaaacccatagaatgtacaacacaaacagtacaccttaatgaaactgttgattttagttaataataataatgtatcaatattggctcattaattgtaacaaatacaccagacgaatgcaagatatcttaataataggtatgatgagctagggagggtttaaggaacactctgtattgtctgctcaattttcttgtaaatgtaaaactgcctccaaaaataatgtctttttattaaaggaaaacatgctgctaccactatgtgcttagtgtcctatgcatttcaagtctgggtggtatgtctagcagaaatatattaacatgtcccaggctgatggtattgaataaaggatttagatggccataaaaaatggattttgtataatggatttctgagttgataagaaagcagtatgagtatatcaccataatacaaaacttagtgatttgaaataaggcaaacatatcatcaattttgccagtgtaatgataacacacacactgtataaacagatattggaacatcagtttgtcactggttgttcaggatgtagaatatacatcaacttaaattttcacatttagtaaagctctagcttcctcttatgctagctccataaataagacaaattttttctttcatcctctttgatggccaatgccggcctaaactcttgcctgttaggaattagtacacatctcctagctcagagacacctacacgagtgactcttggccagtggaacctggttcactgtgccctccagtgtggggccaggcattgttcctctcccttgcttggcatcccagtcttgtgggccctctttcagttgttcattcactccctgcttcctctcttcacaaaaactactctgttgaccttggtttagaattctctacccaccctccacccacctctttatgctgatcctgtccttgtcctgtcttgcaaggctcaacagttaagtctcagggcagccttccctcacccttcagtcctgccgctttatataaccatcctgtagactcctgctattttccatcagcctgagagcctcagttccctggtgtgataatgtgactaaagtcagcctcacctaattaaacagggagcccccagaaagcagggctcactgtcattcggcagtacctgccctgagtctggcccatccttgctgcagctcaggagaactcagcagcccaggacagcaccttcgtagggctcagcaatacagctggaactaagggagggaggaaaagaaagaggcagagaataaatgaatcaacttagccagaattttacagtcagaaaatctacaaagaagtgggtttagtttcaggatatatttgcttttaaagacaaaatgacattttaatgctgttattagtggtagggaatgggtgacatgtccatgtgttggtgcttgaggtcactaaacaacttaacatagctctgagtagaggtttcaaagagagttttcgatgaaatgatttgttttacaaaatagggcacattatctcctgttttgttgtggaaacaaaacccatagaataatttcccttttaagcaattcttctttgtttctactgagggaagctgaactaggaatacaccgtgttagatcaggagagattcaagacagacattgggaagaattttctagctggggtgttgttaatcactttcgcacagtaaaaaagcctgcagagcagccttttttttgatgagagttaaggcaataagacaattaatagtctaacccagtaacagctgaattgaccagatatccttcaagacttctcagagacttcctcagcacatggacttgagctcttacataatgttctcattcacagactgcattgtgcctgcaatctcatgtgtcattattattagtagtaatagtattttagacggagtctcactctgtcgccaggctggactgcagtggcatgatctcggctcattgcgacccccgcctcctgggttcaagcgattctcctgcctcagcctgccaagtagctgggattacaagcgcctgccaccacacccagctaatttttgtatttttagtggagacggggtttcaccacgttagccaggatggtctcgatctcctgacttcgtgatctgcctgtctcggcctctcaaagtgttgggattacaggcgtgagccaccgcgtccggccccatctgttattattcaaggtattttagtgcatcaccgcacacacgatcttgggtctcgccattattttgttatccctgtacttgaagaagagagacattctgactggcattaactcaacattttgtgtgatggactactacatatggctcggaacgcatttttgtttgctatatagaaatgatcttctcttcggtgtgataaataatacagctaaaagtctcagaattaatcaaacttaccatcaattaatttcaaatttttgactagtttccttaagtatttaaattattatgatttgcaaaataaccttgaaagtcattcagtcagaatggctttgaaataaaatcatcatatgttaaagtaagaaattatatcctacctaataaggacaatagatacattaaaatagtctcatcaagtatttgtctttagttagtagttatttctccaagaaagtattaacttcaattttgaacaaagttttctttctttttctggcagtatcagccttttgccaagctgaacacaaggggatgaaaagaaaatctgggctcgaatgtgcaatttcatattttatgttaaggcaatttacaacatatcataaagctgcattaataaacagatgtttcacagtctgcagaatataaaataaatgtcttgaataagctaccaagaccaaggcactttttggagcagatatttttgtcttaaagttttatctcatgcaaacactgtatataacacaaacttatataatcaatgcttttagcaaaatgtcatagtagaaccaaagcccaattgttagctgaaatctatataaatataggtatgtagaatagttaggaaatataaatattagcatatgctctttattgttgatgatatcaagaattcttttatgaactcagaaaagttttttctctttatattcaaaatgaatttttctaattactttctttttcacagggttctccctgtctgcaaattataaccattacagctatttctttcaagtaaatatctcctttgaatcagtcttagtttctccaacacctagacaatgcctggcacatgtaaaggcattcagaatacaagtaaatgcatgcataaaatgaataaatatatttacaagatatttatagacatgtcataggaatgtgggggccaagaagagggattctagcttttgggtagatacaattgcagataataacaataacttacaaggtgcctaaaatatcaagttaccgttctaaatgtgttagatctattggttcatatagtgcttgcaaaagcccttgaagtatagttttattatacttaccattatataaatagagaaactaaggcagggagaggttatgttgttccaggttcacgtgacaattcaatggcagagcttgattcaaatttcatacttttaacttacgtacaattttgcctaccatcaagacattcttcttgctgaatggaaaaaggccctcaaagggaatttatggagtactattacacataaataactctgcatataagtaattcttctgtggaatgatttcatcttatattctcagagaatgacacattttatgtcaaataaatacaggagaaagaaaatgattttataaatgttactaacactatcctaacaaatggaagagatatgataaactttacattctaatttgaaatttatgaaaatgatacacaaaacactgttttgagtagactctatgtcttatttttgtgaggccaaaatatctaatacatttattttatgaaataaatgcttagggattattttatttgttgttgtaaggaattatgcctactgaaatggacaaagcattgtgattagtgttgggtcttttggctcagactcacctaaagggaacaaagaggaacaaccagatggtgaaacggaggttcctccatcctctgatagcttgactaccattgcattttagtaaatccttaaatcgtatactatgcttatgacaacttaattttttttgtaattgatgatggagttgataagttcttgtatacccttgcttgttagatcaggagagactcaggacagacatcaggaagaattttctagctggggtgttgttaatcacttgcccacagtaaaaaaaaagcctgcagagcagtctttttttgatgagagttaaggcaataagacaattaatagtctaacccagtaacagctgaattggccagatatcctttaaggcttctcagaagcctcctcagcacatgaacttgagctcttacataattttctcattcatagtgactgcattgtgcttgcaatctcatgtcctattatttaaggtacttagtgaatcactgcatacatgaccttaggtcttgccattattttgtaatccctgtactggaagaagagagacattctgactggcattaactcaacattttgtgtgatgaactattacatgtggctcagaatgcatttttgtttgctatacagaaatgatctgttaattatatgtgataaacaatactgctaaaaatctcagaattaatcaaacttaccatcaattaatttcaaatgttcactaattattagcgagagaggagtgttgaattatctaatcataattgtacatttgttgatttcttcttttagttcaattaatgtttgccttttgccaaatttgggtaatttttcctgttaggttttcaaaattctttcagcactgcgctccttttcattttctccttctgagactcagatgacatgtatgttggaactttagttattgttcctcaagtctctaaggctctaatcgagactttttcatctttctttctctctattgttcagattagataattcctgttgatttatattcacgataacagattcttacctctttagttttactgtaataaaaagcttacttagaattttgtatgtcagttattggattttttggtcctaatatattcattttgttcctttttacatcttctatttattttctgatacttctagttttccattggtatacaagtgtttgtgaccgggcatggtggctcacgcctgtaatcccaacactttgggaggccgaggcgggcagatcatgaggtcaagagatcaagaccatctggccaacatggtgaaaccccttctctactaaaaatacaaaaattagctggacgtggtggcgcatgcttgtagttccagctcattggtaggctgaggcaggagaatcgtttgaacccggcaggccgaggttgcagtgagcctagattgcgccactgcactgttgcctgggtgacagtgtgagactccgtcccaaggaaaaaaaaaagtgcttgcgaccacttgttggaacatttttataaaagctgctttaaaatccttgtgatgtaattcaaatttatttttcttctcagtattggtagctacttagtactgactgtcttttctcatgtggggtgcagtttatctgtttttttgtaattttggattgtgtcatgcacattcagttttgaggctctgggtcctcacaaaatattaggcggatggatgctgtttttgttttagaagcaattgaccttgtcatattcaagctgcaagttccaatctgtgttttgtgagctgtggttccaacaatcagttgagttttcaaagcctttccagttttcttcagatgtgtcctggtggtcagtgtggaagtcggatgataatctgctagtttcgttctcaaaatctttggttaactaattaggagccgatccacacacatgcagcttggggatgcgctcagttcattaaaaactttatggtgtcactttctcatactccttcctctccacaatgtctccaatattttctggttccctggagctcctcttttctgttttctggccagaatgctgggtctttgattacggtactctgctacagtgtttcatggctgcacccatgtttggagccgacaggtggcaaaatgagaaaagactttaaaaagtttgcatcaccctcttgggatcactactgcaccaactggagaggaagatgccctggcctgagggttttgtttctcctaggcactgcctgctgctgtcaccacaggaattcttgggggccagatcacaagggctcagagaaaacaaacaacaacaaaacggagggatttctgcattctctcggagtaataggtgtcctctttcctgcccaaacttgtagggcttatccttgatctcagcaattgctgagaaactgttccaccctttacatggaaaacagactttcttgtttgcctcatccctaccagtgtctttctctctacacctaagttcaattaccagctgccctttatcattgaacttgatgctttcttctcatagtagaattaagaggaaagtaaaatattttttgtacctatatctttattatatttagacaaatcacagagtgagagagtaggggtttcaagaacaataggagagagacagagaacagagaaagaactgcttgtggaaatgcagaatatcccacattttcaatgtggaaagtgtatgagggtctgaaagaaaataatcagtttttttttgtcctgtaataggcagcattgacaaatgtgtaccagagtttgggtacatttgagccagttcttcagaatcgtggggtgggaaatagaagaaaattatttacacctaactctaggcagataagtgtgcttcaaggaaaggcaagggcctggctagattctagatgtttttaaactggaggccagagacagctttagggagtctatatacaggcacaaatttatttcttttatattattcttgctctttgaaaacggtctttatgcaaatacacactatataaccaaagtttctctttgttccagacagcagtagggctgattggagccattgtacagtgtcaggaacataccagcacactgagaatagcatcatgtcataaggacccagagcaggtggaccctgctgtgatgcacaaaggtgagggtgcagctgcccaggacacactcatgcatgtttgtgtggaccatggaagatggcaggggaagagctgtcaggttgttggggcagagggtgcgcatgagtactcgcctgtaagtcatgttgtagaatcacctcgcacagccgctgtatcttcccaccagcatcaccagataactcccttatcgtcacttcaataatgcttgattttgtctgacttttttatgtttaccagttcagataaagagaattgcactctcatcattgctataatgtacacttttttgactactaacgagtctgagaatctttagatacatttgttagtcattaatgttttttctctctcttttttctgtttttgagatggagtcttactctgtcaccaggctggagtgcagtggcatgatctcagctcactgcaacctctgcctcctgggttcaagtgattctcctgcctcagcctcccgagtagctggggctacaggtgccccccaccacacccagctaatttttgtatgtttagtagagacggggtttcaccatgttggccaggctggtctcaaactcctgacctagtgatccatctgcctcggcctcccagagtgctgggattacaggtgtgagccaccgcgcccggccatgttttctcttcttaatctgtttgtactttcatttactttttctttcttttttaataagaggtttttattttggatatcaatctttatatcttcagtaatgttgtaaatatctttttgttcccactagcttttcttgcaaacttttattcctagtgtcttgttgcacagaaattttattttattatggtcaattttgtcggcctttatctttataatttgtatggggttcttttcttgtttgtttttgatttgtataaaagtgatttttttaccctaaagtcaaaagttaaaatttaatgttttcttcctatttcagaggaccatgcaagatatgataaagatctatgtcactgaattttggttctgtatttgtatctcagcttcccggaaataaaaaagaattctaacattcatactttcagtattttatgtgacaggttttgttgtcaaaatcaagtctgagagcaatgtttattggggcctttaattggagtcaccaagcgataaaggggacattgttttcaacaataaccctataataaacacgttttggacaataaatatataacagtttcttaaaagcaatttcttgggcaatcaagacaatatggcttgagtatggagttatatgatggtctggattaatccagtattaaatctctggttattacagaaatcaatggagcctattcttccaaataatccttaaatgttacttatctcaactgagattttggtgaaaatttagctttagagcttttattgacctgccaatgacctgaagttaagattattcttttccaccgaatgaagacaaaccacctcataaaaattaacccagaaggctgtagaggtgatttgttttcttcatttctgatgacagttaaatagcttgactaaaactcttggttccctaaatggcttttctgcttttggatggtggtagcctggggaacgtaaggaaagcagatgtctcccaaaactgggaataaaatacatggtttattccaatacattcaaggaaaccccatttccaagctctttaaactaaaacattactgtaaacatgttggcctaaaatttttcagagctagaaattttcagagcaatagctgccagttgccaccatgttaggaaattctcattaattcttacatgacagttgtctacatagagatgaaacacttgactaaattgtcagcagcacaattgtgtccacacagacagatagaacaaatccaatgctgtgatgtagtttaaatgtgcacatattaactgattagagagctagaaaatggagggtatttttagcagcatatgataaatatatttctgactgcgttgaatattttttaactgctttgttctagttactggggattatatagtaggaagtaatacagacagatgtcacgtcctgatgggccttgtatttcagggatgaaatgggattttgttggcaccaagacctgattgctttgccagttaccctcacccctggctcatggggaaagagtattgaggagattctcgaggaaccacatgagtttcaatatcataagcttctgccctgaattgaaaggtaattttttgttgaggagggctgagtcacacttatccacaatgcctcctttggcatagaccccagataacccaaagtgtgttctctcaaacagatggagaaaattagaggatagaaaatatcaagagtgttactgaggatgctgccagctgaaccaccatttatgtttttcatagaacaaaacttcaaggggtttaagtagtcagagtgtggccagcttttccttggaagtatttatgcaaggaagatgttttatattctggaagagggcatatgtgaagggcatttcagaatgatgtaaggtgtatgcacaggtcatgtgatggagtggtctggggtagcaggacatgtgacaggcctcgaagttcaccactacaagcatggagcccatatccacaacatcttaaagcgcagaagctgggctgtggggtggagtagttcatgccaaaaatcacaacttggtttggaaaatgagagggaagagaaacttccctaaagagaattagaaaaagtaaaactcgtgaggtaaagctgtatagatttgaaataataaatccttacaatttttacttccactggtcgatggcagggtttcttaatcttagcagtcttaaccttttgagtcagataatttttaattcttcttgcagaggagaagagagggtacaggctgttctgtgcaagatggcatgcttagcagcatccatagcctgtactcactaagtgccagtagcaacctccagttttgacaacccaagatgtctccagacattttcttccctggaggcaaaaacagccctggttgggaagcactggtttatgaatagaaataaaactgtagtgttctccagccaaacaaacaacaacaaaattaaacagcatattttcaatttattgccttccttggctagtacataacccactataattaaagcttccaatcagaaattcttcctcggttaaaaaaaaaaaagctatcaagagaagcaatttagtaagctgggttttaggaatatgctgttaattttgcctaaaatgtggcatgcaaggggagagttatgtaataattttaagtaaataagtgtttcattaaaaaaaaaacccttaaaatggtttgattcaaaaatactgaaatgtcttatcatagacgcataaatctaaatagtttggttatttaaatataacttactttgaaattatcaaggaacatagctaatcgaacctatcattctagcctacatcatcctgtgcatttcacaaaatcctaatgaaaaactacacgaagctcaaagtatagataaacatatcagtgttgacaacggtgaaaccacactatccaaaggctacgagctctgaggaattcctgttagctacagcacatgtaggatcaatgaaggaagaaaatgaaggctcctgggagacaaaattatgccaggacaaagctgaagaagagcaacacctgtcggaaatgtcctaagataaatttcgaaaggtgccaggcttggaggtggggcaggcaccgccggaagagacaccttccctttggggctttctttgcctgtgacaagaacagcacttgatgcccttagaatagttcctggaacttctgaataaatatctgcgaaatggctgaatcaggggtggggactggcgttcaggtgggggacccctcaatagtatgaccacaacggaggctccacctggcagggagctgctgactcctgatgctacaggagctcgtctctgtattaggaggtcctgttccacttccagttgcaaatattacatatatttgtgtgtgtgagtgcaaatatattaatatatatacacaaccgcccaagttccccttgccccctgcctagacagagctgatttatcaagacaggggaattgcaatagagaaagagtcattcttgcagagccagctgggcgggagactggagttttattattgctcaaatcagtctccccgagcgtttggggatcagagtttttaaggataatatggcatggtctcaggaagtggggagtgctgattggtcaggttggagatggaatcacagggggatcaaagtgaggttttcttgctgccttctgttcctgggtgggatggcagaactggctgagccacattaccggtttgagtggtgttgatggccgcagcggcccatctggagaggctgctgccaagatgccggctgcagcaggggaggcgccgcagggagcgctttgtggagcccgcgggagccctggctgcttctgagctggtggggagggagccctgcagtcccaggcgcaagggcagctgcccagccatggcttcggacccgggcatccctgtcctcttgggagggggttgggggtggtggggagggggttgggggtggtgggggggcaggggaagcctatattagaccaaataaatatcatgatatattttatgtgtttattttttaacccataccaatccaagctagattttcttactgatttattttgcttgtttattaatcttattatgtagaatatattttggaagttgccttaacagtttttagaggaaaacaggataaaaataaataaatatataaaagatgccagttttccttatatgtatatgtaatggtgtaaaaaaagcactaaataaaatgatcagtatagtggctagggaaataattacagttaggtttttgggccaggcgaggtggctcacgcctgtaatcccagcactatgggaggccgaggctggtggatcacctgaggtcaggagttcgagaccagcctggccaacatagtgaaaccccgtctctactaaaaataccaaaattagctgggtgtggtggcaggtgcctgtaatcccagctactcaggaggctgaggcaggagaatcgcttgaacctgggaggcagaggttgcagtgagcagagatcgcaccattgcactccagcctgggtgacagaatgagactgtgtctcaaataaataaataaataaataaataaataaataaatgaaataaagttaggttttgaatgaattgagattataaaaatatatttcagaaaaggatgcagcaaatatcttttgaaaatgcaagggcagaggtatttctggcagaagtaatgatatgagacatttactacaatatcgtttctacttatgctcctgtagtttactaaaggcaattattgtttcattggaaatgtaattaatgaacatgaacctcagtaccatagattgggagccatgagtctggccctgggctgactgtggttggactcactcaggaaccgtcttggctagtctcttttaaataactgctgccagctactgccagaagttgcaggatgggaggaaaggaagctgactggcccagctgatccataaacagccctttaatagcactgcagttgcttgtgatgcatgcctgggattctaggtttgtgtctttcttttgtgaggggtttctgtctcaccctcaacactgttctttgcatcgttcaggctacacatcccagtgtgttcccatctcctgccctctagtctgctgaaggttttgcatcctgttctcagcatggacacatatcttctcttttgtccatcacatggtcatttcaataggatgttggtagaataggaagaagatgcacatgtgtttaactaatcatttttaattagaaagccagaggttgaattgaaaaacaactcatattgaaactgcatttgcaataattataacagtgagaaaattatggcagtggggaagatctaatatagccaacttccctcttatattttaccttcatgttgccttaattattaccaggcttaggatgggctagctttgggagacatgtagtttacagtttaaatgataatattccttctccaaaacttaatcacctttataaagctaatgagagacaaccaggctaggaggagaagagcctgaattcggcaaaggtgtagacataaaagactgccagccattattccagaggtcacgagatatgcaacttttccaattactcctgcagataacatcacgactgtagaacccaagattggccttttgagatagcctttcagatattttgcgtgtttggcaccaattatggtgccttctgaacccaccaactgctcatgtggccccatacagaagcagaagccattcagcacagagcaggatcttttcccatgttaagattgcaccccccaagcaatcagcagaaagcatccattgcctagccaccctcatcacttcccccaaattacctctgaaagaacccgaacctacaagcttttgatgagtttgatttaataactccacctcctgtgtggtgtggctggcttcgcatcaattaaattcttcctttactgcaatgccctggtctctgtgaattgatttttttttgtgcagcaggcgggaagaacccatcaggaggttacagtatggttgttgaacttttcaatttatggagttttaaaatataattaccaatatgtgtcttcataaaatacttttacactatgacactatacaatatttttattagatcttatttgttatttatgatttttcatcctaatttttaaaactatgatttttattagacttttatttacaatttttattatgaaaattttcaaacatacatggaagtagagacaaaagtaataaaacccaatgtattccttacactctacttcaataattataaatatatggagtagtcttaaaatttcatatatatccctcccacaaacacacactcaagcataattttagcacaaaccccagacatcatattatatcattttaaaatatatagctatgtatctttaagggaaaggacttttaaaatacatgatagtagtaccattaacacaactaaataaattaacagtaattccttaatatcatctaatgtttggtgttcaggttttcatgattgtctcacagatctctttttcagtgagaatccaaacaagtccacgcacactgcatttggttgacagaggtttttgacagagcaggagcatcgccatcatggacaagtaccaccattctaaagttccccttgatccacctaaaaaccacctaaatccaaagggcatcagcctaatggctaaggtcagcatgaccataaaccacaaatgacatgtccaaccagaaacattccaaccataggataaacccctccctgaccagagacatgccagcccccagataacctcccctccagctggagagatgtcagccccaagaaaacctcccctctgaccatagacattccaaacccgccatgagcttctcccccatacagaaacattccaagcctgtgataagctctctcaccaataaatactcttactctggaagagagagtgttcctaaccgaaatcggccagaagcccctctcaggtttattctccaaaataaacctgtctttgactcttaagccacttttcatgtttctttcctctttctttaactttaacagttttaattgatcacaatatcttcttcccacctgactccatgtatttgcagaaaaaactaggtcattcgcctgtagaatttcccacattttgtgtttggcttagtgcagccttatggtataatttaacacatataaactgatagttagaacaagaggttgatttaagttcttttagttttatattcttttggcaagaatacttcaaaggtggtgcagtgtgcttcctattgaatcatattcagaggcatgtaatgttggattttctttctcttatcagacttcttaattttagttgttccagtacataaaaattagtatgttatcatggtctgtgattactaatcatttaagagtttatggggatgtaagttacttgctcctgctttgctgtctgccacgagtaaaagccccctgaagactccccagaagcagatgctgccatgcttcctgtacagcctgtggaacgtcattgaaattataagactatcattcaaatggaagcattacagttctttggaaacattattatttcaaaatgaaggagaatgatacagatacactggctgaggtgttttgaggtgcattgaaatgttccaagctgttatttaccttaacatgttcttgaggtaccatggcatggattaaaaggaaatttggtaagtggcctccatttaaacgacttactagggaagctatgtgaaattatttaaaagggtaaggggatcaaatagtacttagccttcatgcaaaagttgtacagaagtcatatggaaatgaaaaaaggtttttttgccctcccccttgtgtatatcttatgggcagtggatggaagaaaataaaataacaaatgaaatgcgatggttgttctgaacaagggtctcaaccaagtgcatttattggcataggaaatagtgaccaagaaatgcagcagctaaacttggaaggaaagaactattgcacagccaaaacattgtacatatctgatttagacaagcaaaagcacttcatgttgtctgtaaaggtgttctgtggcaacagtgatgacattggtgtgttcctcagcaagtcgtccaaaccttccaaaaagaagcagtcattgaaaaatgctgacttatgcattgcctcaggaaaaaaggtggctctgtttaatcgactactatcccagacagttagtaccagatacttgcacgtagaaagaggtaattttcatgctagttcacagcaatggggagcattttacattattcttggatgatgatggatcagaaggagaagaattcacagtctgagatggctacattcattatggacaaacagtcaaacttgtgtgctcagttactggcatggcactcccaagattgataattaggaaagttgataagcagaccacattattggatgcagatgatcctgtgtcacaactccataaatgtgcatttgaccttgaggatacagaaagaaagtacttatgcctttctcaagaaagaataattcaatttcaggccactccatgcccaaaagaaccaaataaagagaagataaatgatggtgcttcctgggcaatcattagcacacataaggcgaagcatacattttacgagagagtgggccctgtccttgccctggtcatgcctccgcctgtcgtagagagccttaagttgaatggcggtggggacgaaccaatgcttgaacttacaggacagaatttcactccaaatttacaagtgtggtttggggatgtagaagctgaagctatgtacaggtgtggagagagtatgctcgtgttgtcccagacgtttctgcattctgagaaggttggagataggtccagcaaccaatacaggtttcagtaactttggtccgaaatgatggaatcatatattccaccagccttacctttacctacacaccagaagcagggccgcggccacattgcagtgtagcaggtgccatccttcaagccagttcaagccacgtgccccctaatgaattaaacacaaacagcgacagaagttacacaaacgccagcacaaattcaaccagtgtcacatcatctacaccaacagtggtatcctaactaccgtctttttgctaagacttaaacggacttgagtgcagcaaaaagttgacaaaaaaggagaaaaaaatgaacagtcttttgtggtttattgggaaaacttttcacaccaggtgatactattctaaaaccccactatctatctgcaagtgctgatttgaaatgcagaagccacagtaaaacaaaaaaacatcaaaatgtaaaaacttggaaattaattttttcagctgttttgttggttggttggttggttggttggttggttggtttttgtttggttttgtttaagtgggcaagaagtaaataatgtggctggaatacaagttgaacaaactagaagacataaatctaacatagtttttatggaccaagtaacttgtatattgtataagctttagtaaaaggtacattttcacatattcaccatacccttttttatatcatggtattatagtacatcttgtcaccaaagaggttgttctcttccccactcacctttgagcttttgctttaaaatacattcaggttccaagcctggccatgcttgcttaatctaattatcatgttcttccaagtttttttttggtccgaggctagagcttttttttttttttccagctgaagtcttacgacttttcgtgagtcaaaattgtttggatttcagcaagtcaaatcttgtgaaggcctacatttttttttaagattatgtgaagtctgtgcaaaagctttaaaaagctgcctctgccttgcctgcaacacatgcaatgtatgttaacttagtctctcttcgcagacactgttggtagttatttctgcattttcctttttttaaaaaaaagtatttctagtggttatccaagaggttctaacattcacatgcaatttggtgtggccattttgccataaatgagttaatagcgcagaacatgttgatatttgaagtgttctctctccttttcccataacgtaaatacattatgtgtgttccaggatttgttcaggtttttccccgctcctgatcttgtacataacttgtattacgtataagttaaacatttcattttgaacttggaatgttcccagtgatttcatccagcagagtattttctgccttgttggcaagtgacaaaaaatatcatgagaagcatctgctaccagttgggagatggtgcccttatggtagaatgaggaagatctcagcaaaagcatgttttattaactttactttttgggggtgttggagggggtagcctaggccagaacatcattgtaatcttaaaacataagatgcttttattagatgatcaactaaaatagctggaagacagtactttagaaacagatagttgtaagattatgaaatgcaaatgtaacttgtgtttttatttttcttttccctgccttttttgtttgttttctcttctccagtactgagcatctccacaaatgtctcctaactcagaaaatgtttcttttcctttcagctgagatttggttgcattcagggttgtacattggccttgcatgcgaaactcggcagttgtaccttgctttcattcctgaacttcgcttagcttttgttcggattcttcgaaattgcagcagactctttgggctacatttagtacaagaaccacgtgcataatatgatacggcacagtctagtaatacaatcatccttcttagagtaaaaactacctctagattgtggtaagcttttactgtcccataaaacaggagccacggtaatttatgaatgcaaaactgtaacttcctgcagtgtttccatacagaacattgtctttctggtttcctgggctattttgaaaaaattttcattaatagacttttcagaaattattattagtagcatttttttccagctttgctgttttcatcactcattctttgctcagactccagcattcagtaccgtgttggtccagatgtaggtttatatgctcatttttagcttatttcttgtaccttgcagcacactctacgcactcagcccttaaggggtttactttacaaactgtgtgcctgtaagatgtattagcaataagatagaaaattgagcaagtttataccataattttgtagaaaaaaagaatctgctcaattccatatttcatccatgaaaaacttgcaatacgagcagtttcaagcaataagaagaaaaaaaaaaagagtttataggtcggccaggtctgatggctcacgctcgtaatcccagcactttgggaggccgaggccagcggatcacttgaggtcagttcgagaccagcctggctgacatggtggaacccctgtctctactaaaaacaaaaacaaaaacagaaacaaaaattagccaggtgtggtggtgtgtgcctgtagtcctagctactcgagagcctgaggcatgagaattgcttgaacctgggaggtggaggttgcagtaagccgaacttgtgccactgtactccagcctgggtgacagagtgacactcggtctcaaaaaaaaaaaaaaaattttatgggtcatttgtggtttatttatttctgcaaaatgtccattcccatctttagcccacttttaattgggtgattttttttagtaagaaaaactttatatattaaacattgatttttaaattatttactatatccaatcaacagctttctttaagaactctctaatgcaaaatagaagagtggtagaagctgagtacaaaaaggaaaaaattctaattaattaaatgtatctttgattaacagaaaaataatataagctacaataatattgttatttcagaattccccagttacaaagtaacagtaagaagatggtgatctacaaaactttacttgtgacataattctagtgtagtttatttaagaaatataaaagaaaatgattggattacaaaaaagattaatataatgatacatcagtattatgagtatctttcttaaataaataatattttctgaagacatggataataaaaaaggtagcacaataaaattatacagggacaacttattaaaataaataaacatgctcagttcattgtaatgaaataaaatttgttttctgaaaacaaatggaaagaaaataataaccatgttagcccagagaaaggaatacacttgaattatagatgaacaagggcatatactgtgtatgactatcatgtaaccatgaagaataggtcaagataagggaaaagcagcagaaacatcagttctcaggcagtggtgcctgagattattacagtgtgcccaattagtttatgtcacttttaaaaagtcatttaaataaatgtatttgtggaagaaaaaatatctgaacatcaggtatggtctgatccacaatgatccaacgatctgtcataactcattctaggagtattcttatacagtttgcaagagaaattacatgtggagctacagaggaacatttatcaaaattcataaagctatttaacctgaatgttacatagtacatagtgaccatcatacaatagtaaaaatacaatatctgatactatttttacaagctatgacgtaaacaatttaggctctttttaaaaaaataaaagaaatttgattacaactttatttcaagcattttcagttagacataggtttatatattttcactcaaaatggcaaaggaccttctgtaggtaaaatatattctgtgtttaaatgcttgcattctgaagtatgatttgccatgtacaagttcaggtaggacaatgaagctgctgtagcaaaatcctggctgatgatgaagactcggacacttttcatctttcatgcagccattcaatattttgtgtatttacatgaaggagaaaagaggggaggatacaaagagagccagtattctttttggatgaagcagcctaattccagagaatgagctttccattttgaactcaaagactgtggtccccaaattgaattcttaccagtccaaggagctgcctttggcctgtgaggcaacacttgatgatgaagtgagctaggaaagtgttaactgaactacagagatggctgcgtgcaaaacaagtttccaaacatgctcaggcccacgcagaggtgaggtgcagccagaactattagttaaaaataaatgccctcacggatgcagacatagagcttgtaggaagagtcaccgttctgggggcctgattgtagtttccaatacctgccttcaccactctctgactcttctatttttctgctttgtttaatttgagtccaaggatttcattagcaactttctgaaaatacaggaagacagtctcctgttttggctgagataaagtggctactaaaaccattttcctggcaaaaccataagtgtttttcaggttttactgtttccatgtgctccaaataaattttattgctcaccaaggcaaccagtagcaaagcttctgactcttcgctccctttcttcggtacaatgtacacatcttttttttttttttttttgagatggagtctcgctgtcgcccaggctggagtgcagtggcgcgatctcggcccactgcaagctccgcctcccggggttcacaccattctcctgtctcagcctcccgagtagctgggactacaggccccggccaccacgcccggctaatttttttttttgtatttttagtagagacagggtttcaccgtgttcgccagaatggtctcgatctcctgacctcgtgatccgcccgcctcggcctaccaaagtgctgggatgacagacatgagccaccgcgcctggccgtaccaatcttttaaattctccaagctttgctaatttgtaacaagaggattctctgtggtccatagataaatgcatccaccttcttgccgcgtattgtacgcaccccctacatcccatacttgaagagtaacattcaagtttcctggcaatgttatcccgctcaaaaaatatgtatatatattcatcactatagtttagttttattggttcccaaaagtttcttgagcaaaactcataggtcttccaggaggtgctgcttcaagcatgacaaatttcagttgccattcttggtttctttcttggggtctgatggagttcagtgtggtgctcaggctagctccccaggcagagggagaaggaaaggagagcgcctccgtaggtggggagagaaggaagggagcaggaccctgccctgggatctgggtgccctggagagatcaggggaaactagttgatgatacttttgttaaatgaaccagtactttcacatgcttttaagtaaaaatgaaatttaactggaaggacccaaatcaaacatggtatctcttgagttatctctcactatggatgacaaaggctgttgtcaaagttgatttcactcaattaacttgatggatattaaacaacctgtataagcccagaaaatgagggttctgggagatctgttattacagaaatgcagaggtgtcctaactcgtgttatgtgaaggtggccatgatgcagataaggacatggctatgaatgtgcaggctatagtttgccctgacctgggtccatgaccgtgccttgagggtggaagaaacaccagagcgccctcagataagatggctggagggcatgacaaaaaccatgaaagtaagaccagaccgtgcatgcaagatgaatgctggcatctggctgaatagaggaatttgaacaaacaaaatcctttttctgcaagctcttcacataattctactccacctggagcttcatggctgaaatgagtggttatctatattcaggtctagtcagacgtgctgattaattatagttgatcagcatacatatatcatgctttcttacatatttaatctatcccatgtatacataagattttgaaggataaattatttattagcattaaagtgtaaaatttgcttgataactataaaatgccttaaatacactagtatgagtttcgaaattataccaaaatgaccaatgtgaagggtagtgttactacactgggtatgtcctgccactacgtcctttaggagatttctatagcatcacaatgaagtccacctgtgtgtgagagagaggcttgcgctcgccttccttaccagcaatgcaaaagtgctcaggggacccagcttggtctgagtacgaaaacaaacctaagaggcttcaaagccagctctcctgtagtatgtgctcacatccctgaaagaaaagcaagaaaattccaaactccagattttctaatataagctctagtgaaatacttacctttcttgagtcaaagcagaagcaactgctaactagaaatgtcagcctgctgcctcagagaatttctatggctgttctggggtgaagagggtggagtctttggctttcttaccacaggtgatcaggtaagaaggaaccacagcatcctctatgaagaaatgctgtccgaggtgatacctggaatccaaagcttttctaaaggagacctgggaggggactccacacccatcaaccaatagcagcccagcccaaaggctgcaaatttgcttctttctgacacccagtggagaaacaatcaccagctcttttccagcgagtccagcactgtctgcaattggatttgctttagttgcaaggattgtaagctagttggtgtgtgtgtgtgtgtgtgtgtgtatgtgtgtgtgtaggtgaagtttgagacacctggtgttagtgtttctatccagttgtactaaaattggcatgaaatttcttatctagaatttcaagcctccagctgtgagccttattcagctatcattgatttcatcaccaaaaaagataaaaccaggaaatagaatgcgtgtgagagagtccaaatgattgtttcttttacccttaactaactccctttccttagcccctctcctgcacctactggttttctaaggtttattcccgcagtctttagtaaactaattttaaatgtgcgaatggggtgaccaggttagagactcccagggaagaaccatgctatgtatcccactaataagttctccttatggagctaaagtctttcactggagctgtttccagtgtaacttgatgtagcatttgggatagtctcatcgtggagcaccaccactatcccagttggccgatacctgtttcttctaagaggagaatcaggtaagttttcccaaagcgccttagggaaatcgtgccattcagagagctgcgttgtgctcatgcatctggaaggtcttgctgttcatgcactgactcttctaactccatatcctccattcctgggtgtttgccagcaggatggaatgatggctcactgaaaactgaagaagacatggaagacaaaaagggagatgagaaagtcctgcccattaatgataggaagatgggcacaatgcggtgacctcacaggtctccctgtctcagctcagctctgatgaagaggctcatgtcatacagtctcttcagatgatcacagagaaaaacgtggtgacagagaggcagatgttttactgtttccacttctggaacttgttgcagggtatgaagagggtcagcaccagagaagatacagaatatcatgtctgcaatggatgaagccatcaaaggatggcttcacttcaccaccaggcagcactgaccaacttatggcaataaatcccgcagaccagaattgcacccatcaaatgcctcactcaccatatgtcagcccagaagactcttgcagtggtgagccagtctctttatccaccaagcctgacccagcaggcaggagaggcccagtaccaagatgatcatccacaataacctgcacactgcattgaggatggaggccagccctaacagcccgcagccctcaggagggagaggcagtaaagggctccttctctctttgtcctgatgaatgggcattgcactagaaagatgaacattaggagcagattatcagagcctcggtccagccaccatctcctctatgatgacccagatgggcaaaccttctgaaggcaaaggtccaaccaacatcctgggtggctggcattttctgaatttctatagctcatcacaaagtgcagcaggaatgggagtatttggtgcactttgattttgcagttgcctctgatggccaagagtcttagggccaaagatttctcctgacccaaggtccaggtcatatttctgcagcacagctgtgaccctcatcccaactacagccactggcacaatctccagtaatatttgcaaatgattatactcacatcaggttataaaagcttgttgtttttaatttgagttatatttttaaaatacaaaaatgtcttgttttttatgtttgtgttcatgtggtacattttccaggataagatgggctgtgcggtaatggcaaataaaccctccaaatctcagtggctggcctcctctaagtttatttcttgctcacggggtctgccgtgagaccagagtctctccagagcaactccccttccacccctgcccaggaaatagaacatgtgcgtaactgagagacaaatcatgtagaaaaacaaggtgattttcctagagaaggactgaagtgctttgctagtattagtcactatgataaaaagtagagaagaactattctatttctttaaccatctaagagacagaccattcacttggagtgaaatatttaaactatttcttcatctcttgaattaaaagaccttaataatatgaattcataactcgaatatagataataaacccagcacagtttggcacaacaatttgtatttcctcttgaaataccaaggctattttctcatgtaaattatatacgtatctatatacatattttcaaggactgaaattaattttaacatctttaaaacaccaaatagtatcacattacctgtaaaatggctggttacctcaaaggcagcattttaacatccttagctgctttaaaagattatcagcagtctatagcaaatattacatgagacatttaaagaatggtgcttcatttcatcatttaaaaatcttagtcaagaagagacaagaacaatttcttagaatcaaagctccttcattgggaaatcattcatcttggaaaaagcagaaatattttggctaataaaaaacattttattactaaattaacattgaagaagttgtaaaaatctcattttgctttaatttgttaaagtcaaagccttatatgcacctttgatttttataaaattttaactctttgaaaataaaatattaagcatcaaaagtaaatagaaaaaattaaaaataaaatgaaaaccaatgaaatggaacacagaccaataataaaatctgtgctgccaaaagctgatgctttgaaaagattattaaaaactgcaaaacacctagcaaaaggaaaacatcaccaatatcaagaatataaaatgggacattattatagaccctagagatactacaaggattataataatatgtatgctgaacaacttgaaggcaagaaatttgacaatttaaatgaaaagcatgcatttcaatttcttatggtatagttacttgcaactctggagagcccacataattcatatagtagccatcttctagctttgtgggttctctgtaaaaaagaaactggaagagtcacagtaaacgaacgacatatactttccacccttacatgagtagagaataatctgctagagcaaatgggctgggtgtgggggctcacacctgtattcccagcactttgggagtccgaggtgggtggatcacctgaggtcaggagttcgagatcagcctgttcaatatggtgaacccccatctctacgaaaaatacaaaaattagcctggcgtggtggcaggcacctgtaatcccagctactcgggaggctgaggcaggagaattgcttgaacccaggaggcagaagttgcagtgagccgagatggacccattgcaatccagcctggaaaacaagagggaaactctgtttcaaaagaaagaaaagaaaagagaaaagaaaacaaaaagaatctccaaatgctcaaataaactctatataatttaaatgtgttttaattttctcttactgttaggaaattgatattttaagagaaaacaactagtcagtgattgtttccaggagaactccattttgtggaagctcctctgagacctaaaccctttaggggagctcctgggagagcctgagcttctcctgattcaggtcccctttgtgtgttcactaagagtctgctctttgccgagttttgtaacaaggttgttgaaaatggaagagtattttcagccgtgagcttactttgcaacattcagctttctttagagtttcaggaagttcgtaattgtcttataatgaacaagaactttcctataagaagaactacaaagcatgccattcagaaaataggtaatagaccttaatcccaggaatactaaatattttaggaagtctctaggttcagaaaaacccaggggccctgtggactgaatgccaacctcccctccctcccccctgcccccccgacccccaacccctctaacctccacagtgagctccctgctttcaggctcaaccttctaaagttctctttcctggctggatgagtctcccatgaagccccttccatctctccactgctcagagctctccagaactcacattgtgatttaaatccagggtttacttactagtctttacttactagtcaaagccccacatgcttgccctgaaatccctctagttatttagtgttagaaactcaccactaggaccattattttgctgttagatctatttttgggggaaatgcctaatgtcaggatttttttttttttgaaagagtctcgctcagtcaccaggctggagtgcagtggcgcgatctcggctcactgcaaccttcacctcccgggttcaagtgattctcctgcctcagcctcccgagtagctaggactacaggcacgtgccactatgcccaactaattattgtatttttagtagagacggggtttcaccatgttggccaggatggtctcgatttcttgacctcgtgatccgcccacttcagcctcccaaagtgctgggattataggcgtgagccactgtgccagaacaatgtcaggattttttggcttatctttactgacctggtctaatccccacagatgaatatttattgatttatttttttctctttttggaggaaggaagccctgttgtcagcatcctaaaagctagaaatgagaaaagctgggaatctcaattttcagtgtgtgctttgttttcaatattgtaccctttcctcaattggtctcagtggtctccagtccagagactctctgttttatcctctacggaaaatgaacattttgtcctttatacagaaatggacatgtggggccgtcttcaaccactcctaaaacactaaaacagacattcaataaatcctgtttccagccccacttaatcctccaagttacataactgcagattgcagcgctcacatagggaaccctgtgagcagcctcctttgaagctggtcatccctccagccttattcccccacactctcaacggtattgtaactaaggacctcagtttttaaaatatacttcagtcatccactctctttatcttccttcctgccgctctcacaccttgattaaaaccattttttccttccacccatccatgtctcttgactctggcttttaggtggcaagctgctggacttaggaccagatacagtatcgtatgtcatgagcctttggggagctcttcagtttacaacttggtggctcaaagatttcctttctactgctttagacagctttttggggggatgtgttttccgaaatcagctgctctttccgtatagaaccatacattgagattacatgagtggctgtgatgtctaatgtagcagaacatttgattctctttgtctatattgtttatagaaaaacatctcttctcattgatatgtttctttccccttccatctctgttactgtactaaccattaccagatctttaacaataaatttaggattttaaaatatatttgtggcaggaattactgtctgcctctagaggtaacatttgagtgaactgtcttattgtcattggcaacttccttcagatcatgccactgcattacagactggtcgacaagagtaagactgtctcaagaaaaaaattaaaaagattaaaaaaaaaaaagaaacctttctgaggtaataattggagacactggcaaagacatgtgacagagttttcactttcttttattacaaggtcaaagtatagaaatacctaaatattgaaccatggagagatgattgaattgtacaatattcctatgtatggctgattgattcagttagaactttactcacatattgaacttcaaaattttcactcccccgaccaatgctttttagccttctattttactttgcttcttaacactcatcactgtctaatatactatatttttcttgtttatggtctgcctttcccagaatagaatcttcatgaaggcagagatttttgtttttatttcgttcattcatctagctccagtaattagaaaactatactgcacatggtaacaactcgctaaatatatgttgaatgagtcatcaatgcttttctcttaacttaatgacatgggaaaatgtccataaagtatacaataaaatatgcagactcagaacataaaaaatatacacacactctcacacacacacacacacgacaaaatcttgacttcagggtgttctgctgaacttcagttgttcttgacttccacatgtggaggtggagcatctttgttaagtttataagtaatatgtttttttttgtttatgaaatgccaggttatatgtttcctttgtccagttttgtattcgtttctcttctgatttgtataaattcttcatattccataaacactactcctttttcataggtgttgcaaatcatcttctttccactaatggcttctattccctttttataaagtcttttgataaactaaaatgttaatattattgttgtaaaatgaaccaatgttttacttcatagttttgtgttttgggtatgaaatccttgtccactggaaggtataaactacttcttcatattttctgaattttaaagttttttattttttattttaactcattagaaattacgtttgtttttttgtgtccagtgacaggtaggggtccaattttatattttttctcatctgtaactaatgtcccagtaccattaatatttagagttgcccattctttcccaatggacctgaagcagaagatctcatgcactgggttcccttataattcggctatttctacattttgagctgtttgtctttcttatataactctgtagtcatgtaagtagtcttatgtatggagtctcccttctgatggagttacctaccccactgatttttttttaggctttctctttactaataaatgtatttacaaatacaaaccaccttctaaagaatgctttagttgcaccaaacatatacaagctttgatatgtagtgtttttattgccattctgttctaaacataacttcattttcttatttcaaatgtatttttaaatttcgcaaagtatagtatcttgcgatcttctggttaacaaaatctatgttgtcaaattgtggtctaagaatatgatcatattaattattattattactatttttttttgagatggagtctcactctattgccaggctggagtgcaatggtgccatctcagctcactgcaacctctgcctcctgggttcaagcaattctcctgcctcagcctcccgagtagctgggattacaggcacgtgtcaccacacccagctaatttttgtatttttagtagagacagggtttcaccatgttggccaggatggtctcgatttcctgacctcgtgttctgaccacctagccctcccaaagttctgggattacaggcgtgagccactgcacctggcccgatgattattatttattgatacttgctgtggcctagtacactgcaatttttataagtgtttcatatcaacttgaaaggaaagcattttttgtcatttttgagtattatggtctgttactacccttttcataaaattttcataaatagtgttttcaaatatccttattttgagattttgtttttggtttattgctcaaccagtatctgagggaagtattatttaattgtggcaaaatacaacataaaatgacaattttaaccatttttaaatacaattcagtagtgttaagtgtattcgcattcagaacacaaccagtctccacaactttttcatcttgtgaaacagaaactacatccattaaataacttgtcccctccccacagtgagagaggtattttaaactgtctctctggaatatctgttcacttatcatgattttgtcaacttttacatcatatgtattgaggctttttatatgcataaaggtgaactttattattacttcttactttataataatgtattattttaagcattttaagtacttacaaagctgattatgtatatttagtctctaaatacctgcaaggaataagtatagtgctttatttctaaggagaaatttctgttttcacctagagaatagcaaagttccctatcctttctctctttaaaaaaatcagtctactgtttgaatgtgccctattttctatgtgctggctgggtgcaggcatctctattcccattcattatatcacaaaggtcaaaggctttatctctgatatctgcaatgctatcaacaccccaaactctaaatacagagaatggaaaggagaattgttatgtattatctagtgtctctaggtgtttctaattacaaaagttgggtgttgttgttaattatcttagccagccaactggatgaattgggatgtctccatgacataatattaatctgaaaaaatacagtttgtcgatagcatttactcagtgattccagaaatgtatactgtgagcccaccatgcacatgcttatggaagtccataaatcattctgtccacttgaagcatcatggttcatacatttgggaagagggctctatttctaaagcaggttaccacaacctgcaggcaggacgcagaaactctgaacctctgaactgagcagaaaataagtgtttccagggagggaggaataagaaaggctaacgtgtatgtaacatgtgtcccatgttcactttggggtggagacatagcatttaaatgtatttcagttaggccttgtacatcaaaaggtgaagtggaggatatgaaggcgcttagtacacagcctttgtagaccagccagagccatgctgtggtgggtggtctcttattgggaaggaatgctggtcagtttctgtgttaaagctgcaagagggaggacaagtgtcaggcagttggttgaaatcactgggcaagacttttgaaagggctggtttctgccttcacccttagggaagaaagcctaatggtggttagccattctctagagaaaccttaaaaacctctggttcctttgaccaagaggaagtctgttcagtcaagtggggggcttaggattctctttatttctcaatatataagtcctgcactcatggcctagcatgatctagcaaggattcagtgtgattccactaatgacaatttatttagtcctaagtccatgtgtatggacatgtaaatacatggaagactgctcagcaaaatattggttctgtttatctttgatatcttggtggtagtttcttggtggtaggtagtttcttcttcatgtctttccaaattatttttattttgagggttgtatataaagagaatattataagcaaaccaaaaaatgcaaatagtatatatataaaatgaaaaataattcaaaatatttaattgctcatgatgtcataaaatggtagactctcagtgagtgcatatatttccttaacatgaagttattaacatatggtcagcattttcatttcaacttaatgtagtttatagttctcactatctaaattgacatttactttaaaatatagaaaaagacttctcagatgataataatggtaaggttaattatacataatggtcccattctttttttctgtgaaccaatatgtgaaatcaatgactatcttctctatgaaagttttaggtggcttagacaatgttcatgctttattagagtctcatctcgaatgggcaagagcctgcattgcttaggttagtactggacgtagtgaagtgatccatgccacatagatgcataaatcattttgaacagctgggcagtttcaggaggccaattaatcaagtggaaaccaggtgtagaggccaatgaaaagcttcccctttgccctctgaaggtttgctgaaaaatcaactcaaaaaaggtaaattaacaggagaaatggcatgcaagtttattagtgtgcacaaagagaatcacagagtgattgtcaataccttagtggggttcagaagcctgtataccatgttgcagaaggggaatctcagagaaagcctggctgtttatttcacctatatagattttctgcacagatgcaaatctactccacgaaagtcagcttttctgcactattcctgtctgctggccttctgaatagccacctcaagatacatcaaagaaatatgttttggggtgaaattttttggtttcctttagcaaaggaaaggtttgtatacctttactccttttgtatatcaggcacccagccactcgctattgcttacctgcaccccatcctcattccagagagttatttcctgcttatatatgtttccttgaactgccataacaaagtaccatagactaggtggcctcaaccacagaaatttattttctcatggttcagcaggctgggaagtccaaagttatgttgttttggccagttggtttctggtgagggatctcttcctgtcttgtagatggtcaccttctagctgtgttctcacatggccttctttaactgtatgtataaggagagagaaagagagagagagggagagagaacttcaacaatctgacccctgctttgagcctcatactttgcatatgactcccaaatccatatgcacattaataaatgtgtatgcctttaaaaaaatctgcctataatcagtttgttttataggcttcataaaaagccaccaatcctatcagattagggccccaacctaatctgatggggtgtaactttaattacctaatgtcactttaattacttccaaatgtagtctaaatgaattcaggtcatagcaattcagtccatagcttggcttcacctgtgactgcaggccagctctgacccaggtaaacagatagacttctctgtaattcagtaggataaaacaccttctccaataaagtcttaactacagctttggggaagggcttctctttccaagttcgttcttccttgagtaatcagctctagattaatttatagagttcactcatatcctatagttaatcttttatcatggcataattctttatattaaatttctgttgaaatcactctatggcttttatcttctgatttgacctacactgctacaagaacagacaagctgagaagcatgagcttgaaatataactgcccctggtgttaataattacatttttgtggaatgtatctgttataggactaggtattcattttaattatacttgtactttagttttatttaattatacttgtattatgattctgccatgtaaaatgtaagcctgtgaagaaaatcaaaatatttcacccccaaatatccttctttgacatcttttgagatggctgttcagagggtctgcaaatagaagtagccctgaaaagctgtctttcctcaggagggaggtttgcatccatagagaatctgccttgatacagccaggtttctctggggcccttcctcatctgagtctagtctgacacctttaaacttctcaaagaaacatttaccatctattttctgagagggctgctacctgtgaggtttcagctacataacaagaccagctttgctgccaggcctcctcttctctccctcccataacgtgtcccaccaccataacttgatttaccaccataacctggttttggccgtgctctgagctgccattctttctgtagcctcgaaatggcatacaaacttcaaccatctgaccctcgctttgagtttaatactttgtatgtgatacccaagcccatatgcatgttaataaatttgtatgccttttcttctgttaatctgcctattttcagtttgttttataggcttacattatcaaaacttcagggggaaaatgtaaacttccctgcaatgccagtgcagcacaaagcttagagcatatggtaaccctgacaggagggccgctgcatcggggggacctcacaagacaagtctggaaggtagggacaagcaggcagagggaatcagggtggcagtgtgggcaagagacctggaccacatagcgtctctctcaagagggctgcatgaaggtggtcactaggacaggctaggactgaggggtggtgtattttgaacatgtcgctggggcagaatgacgccagatgttctcatacccacactgctggcccgccatgcagcagctggaaagagcagaacagccttctttctgcttactggtatccttactggtaagcagaaatgcttaaagatgcctgtccattagtacagaacatatattgaagactgcatttggagatcagaggcaataaactgaaaactagcatgattctcttagtcacattttacataatagattctaataatttaagactttttttgtatgtgatttattgtagcccatgtgttacaaaggatctgagaattagacactttaattgtaatatattactaactttaatatggaatgttgttaccccatttatgggagtgaaatatgcttaaagaaacattacaatgtgtctaaagtaacttcttaaacttgcaaaaatcagagtggatatgccacataattgcactctagtgtgaaaatccagagatacaaagcaggtcagacaccacctgggataagctttcacctatcctccttttatgatcagaaattattttgcaaattttgcatttctacaaaattatcttaggttattatctaaattcaccatttaagattcaccattaaaaaaaatttctgggctgggcacaatggctcacagctgtaatcccagcactttgggaggctgagacgggcagatcatgaggtcaagagatcaagaccatcctggctaacacggtgaaaccccgtctctactaaaaatacaaaaaaatttagccgggcgtgatggcgggcgcctgtagtcccagctacatgggaggctgaggcaggagaatggcgtgaacctgggaggcggagcttgcagtgagcccagatggcgccactgcactccagcctgggtgacagaaagagactccgtcttaaaatataatataatataatataatataatataatataatataatataatataataatataatatagtataatacaatataatataaaaattaaaaattctgataccttctaagggaggaggatgtactatttgttctttaaattctcacggtatttccacattagagtccccaaatacaagagctctaatgagaaagtgactgctcagaaatttgggcagacgttttatcgttatgccttcatttctttcattgcttaataaactctaatggataatagtgaacacatttctatgtagtttctgatcaaacgattctgtgaaaatttagtcaaggaatcaagagaaagtacagtcatttctccaaaggagcatttcaacagacatttcatcaaaaacaaaatttaaaatggcaacctgtgtgaaacactttggcagaataataataataaataatttggatgcgagctgaatacatgaattattttactggggtggaggatatgggcattgcatgcttattacgtttttggtttgtattgccctacatgttctttaatgtcctagtgttttgacaaagacaggcataaaatgagcactaatattttagtttctgtcttcttttttttttttttttttgagacggagtttcgtgtctcacccaggctggtgcagtggcgcgatctcggctcactgcaaactctgcctcccgggttcatgccattctcctgcctcatcctcccgagtagctgggactacaggtgcccgccaccacgcccagctaattttttgtatttttagtagagacagggtttcaccgtgttagtcaggatggtctcgatctcctgacctcgtgatccgcccgcctcgacctcccaaagtgctgggattacaggcgtgagccaccgcgcccggcctagtttctgttttcttaaggaaatagaccagtcctttgcaaacacatgttttatttcctagtaaactcatctattgctacaactgtgcaatttaagggacaaatcattcttccttaatctccgttgatggcaattccatctggtgcccaagctaatgactttgggatcaccactcttcttctctcacactctacatccagtctggaaagaaatcttattggttctatcacacttacaaaacctatcaaaaaccctaccactgattaagaactccatcgtcaccaccctgatcaaagccatatttttctctttcctggaccaatttaacggcctctggaggaggactggcccctagatggcctcagcggacccagctttcttctccccttccccatttcctggcttgcagttttagaataactgtagaatgtgctaagaatgcagtatcttgatatatagaggaactttccagaaaagcctgggctttgtcctcattccttgtagaacgggatgtcctataatgcttttgctcagtgacccacccacgggatgccctcgagctaaaacccagagcggtgtgctttcagagtccttcagctgtagtgcaaagtggagcatgtgtagatgagtatatattctctttataccagaagtaagtatagtttcattcagtgaaagtcactgtccctaatctatacaatactcaaagtttaaaaaaaatactctatgttaaaaactgtgagcattgaaagctgacttatctattcagagatcacatatagtaaagggtattacagtataaaataccaagaaagcagatcagctgatgaaaattactgattttcaatgtctttttaatcattatatgacatcctgataagttttcctgaggaattaaatgcttctgggatcttaaagtacattttctacaaacaagtcatagtgttttcttaaaataagctatcaattaaagcaagaatgtggagtagatggcattggtagatacaatcaactaaaacattgtttttattttcactccagagtacggtgagcttatattcacaattagtaaaaggaagcagagctgattttctacaacttcttctgtttcttctctcaaaatcttcagagagaggaaaaggcaaaggaatgcagtattctcccatttaagtcaacattacaaatgcaattaaagggtgtataatattgctaaataagacctcatcatgatgtgtattctatgacagtttattttgactcctttaactgagcgttgtgtgagtttctttagtttatttgttagccactcggttacaaagatcaggatgtttttagctttttagacacaatatttgtcgaagctcttcttctcatactatacttttctaaaatgaatgtgaaagtattgaaatgtgttatcgactttccataaaattctcatttacttgagcctatgtaaacacctgactaaacacacggctattcactgtcaggactttctcctcagcatctgccacggaaaagattcgattgcacgcatacgaacccaatgccagcaccccaagggacagggcaatagaaatgggaggggaatgatcaagtcaatgaatgatacactccattaatcttaatgttaggacattaatattgcttggcaactgcctaaaatcaacaataagcgatcaaccaatttgttgcctaaaagttattgatttaaccatcaataacttaacagcataaccataacaataactttaattttactaactttaaataactacagttctttaacaataacaataacagcatatatgtacatcagttatgcattaaaagatggatattttttgtgtacatctgaatggagaatattagataatgtagaaagacatgagacaaagttgataatacaatcccttagagctttaataaatgagctctctcagtcaagccacagtaacgaccttttctctgtgatatgagccaggactctgcaggtgtacagaggagataaactgcaattataaagtacaattaacaggtagtagcggtctcatttattatacacacctacgcatgtttccaagccagatgatcactaagtattcacagcaagtaatcacccactggacaaaacagcattacttcaccttctgaaaaagtagtttctactactttgaaaagcttgttggtgatgagacgaaaactgaaataggttacaattctaatagacacacagtacaggtaacacaaagagtctttccttatttaacattcttaagcatcacccaaaataccaaaaagaaatacggtaagtttcaaggttttgcataaagtactacactgagcttttaaagtgaagggcttagtcacccaaatactgtcttaggccttatagtatctctcctgagttcccagtatataatttattataccaaacagatcattctccagagttcttttgatatttctagatctctctcaacttataacctaatcagctccctcaatcccacataggcctcaagctaatctcaatcactcttcttccattcatttttcattcacttatttacaaatatgtattttgcatgagttgtctgccagcactgatttaggggcagaaagaatatgatagtacctaagaaagaccctcattcttatgtctctttaaaggaagataaaaacttttaacaaggtaaatatttaaaaatactttaaaggagaccaggcgtggtgactcatgcctgtaatcctaacactttgggagggagaagtgggtggattgcttgaggtcaggagtttgagaccagcctgggcaaaatggtgaaacactgtctgaactagaaatacccacccctaaaaaaaattagccgggtgtggtggcacgtgcctgtaatccctgctacttgggaggctgaggcaggagactcacttgaacctgggaggcagaggttgcagtgagtggagatcatgccactgcactccagcctagttgacagagcaagactctatctcaaaaacaaaaaacaaagaaactttagaagacacaaaatgctataatagcagagagtgacaattgctacaaagaaaataaaatatgattatggaaaacaaatgaactggttgatccaactcctgtctgtgtccactgctaccattttggagtgagctcttgttaggtcaccactcacccaggctccagtgataccctaattggtttccttctgttaatggccttcattgttttttctgcagcgcattcagtctgtcaggttgggttctatagaagcagagcctgcaatagcaattattgagcaacttttcttgagagaataaccttatgagaggggaatagtaagtagggtgagacaagggtgagatctacctaagccaggatgatctcaacacaagactggctcagcctgacacccagagttttggagcatggattgcattacagagttggcctgacgttgaggctagaggaatagctctttataccatgtgtcagtcagtcactggctacaggttgtccaggtgaggcagctcccttaagtctggagaagtgctcaggagagaacagggcacttgtgagcccttagctaccaacaatagtatgggggggtgcaatgcagaggcctagtaaagtgggactgaatagagcagcaccctttaatttaaaagaagaagaaaatggatattgattagaaacacagcagcatctgccacagttagaaaaagcatgactatgtggtgtttctgtaagaacatgagagaatgtcagtgaagcacatcataacagtgattggagcatgagttctcagtcaatggcagttattttgattgtgacagagattgagatgtttataacttgaatagctggcactagaattcctattacagaagaattcctaacgttgaagtactagtttgatgagctgcttgggataaaattgaaacttcaaagttatgcccattggcaagagttaaatcagcaaagggggcaccaaaactatcttgtgtgagaaaaggagaccaatttagtttttgctcctgagaagagaaaagacagaagagaagggaggggaaggagggagatgcaggaaggagagccagggtcatgccagaaaagctcagagggaattagctggccaagcagtggggaattaacttttaaagaatataaggcttggcctgggtgcagtggctcacacctgtaatcccggcactttgggaggccgaggcgggtggatcacctgaggttgggagttcgagaccagcctgaccaacgtgaagaaaccccatctctactaaaaatacaaaattagccagatgtaatggcacatgcttgtaatcccggctactcaggaggctgaggcaggagaatagcttcaacccgggaggtggaggttgtggtgagccaagattgcgccactgcactccagcctgggcaacaagagtgaaactccatctcaaaaaaaggaaaacaaaccaaaaaaaaaaaaaaaaaagaaagaatataaggcttatgtttacagtaatttttgttacacctccatatcttctgtaaggttattgaaaataaactaatgggttatatgtatatgtgtctttttttggtgaaaattgagggagaaaataaatcttatttatgagttaggatgtttgaatcatagagaaagaataatctataaagtgaagaagttggaattctcagccagaggtgactgtactatctggaatatcctgagaaacagaaccaatagcagagacagagggagagcgagaaagacttactatagctaattagcttatgtaattctggaggctgagaagtcaagtttgcagttggcaagctggagacccaggagagccaatgggagagttccagtctgagtctgaaggcctgagcaccacgagagtcaatggtgaaagttccagtctgaaaactggcaggctcaaaatccaagaagagccaatatttcagtttagtctgaagacaagaaaaaagtcatgacccagttcaaacagccaggcaggagttttctctttcttactggaaggtcagagtaattttagttctattcaggccttcaactgattgagtaagggctactcacattagggagagaagctcgctttactcagtctactgattcaaatgttaatttcatccaaaagcgccatcacagacatagctgggataacgtttcattaaatatctgggcacctcatgacatcgtcaaatttccacatgaaattattcatcacaactccacctcttgtcaacttggcatccatgcacatctccttaaactatacttaatctctaaataaagaaaatagcaaggccatgcttctgtctaatatatcatcatcccatgtacaactgaagacacacctaccccttccccagaaaaggaggtataatcctcgaatgatgtttacttttctccttgatatcctgtaacttaaatgttataatataaaatcaacaacacttaaatgcaatgatatagtcaatacctcctacattaaattataagggaataagacagcagaaaaacaataatatttgcttaatgcacccacacacatttgcatgtattcataacaaaaaaggaggaaatgctgataacaatttcaatcttgatttctgtaagtggtcatgtggtcatagctggtatttctagctaccttcttccactaagcacctcacttcttccactaagcacctcacttcttccactaagcacctcagctggtcgtgattatttccttgttgggatgacccaaggcttcattcctgaagggtctgggccattagttgtcctgcctggattaggtggttgtcattttccattgaccataagtacagaatattataatcccaaggacaccctaagggtatatatattgcagacacacccttccttatctccatttggaagtacgagtccaagttccccttgccagttaagatcaataaccagaactagcccagtaactctcttccttgcctattgatttacaggcatgaggaatccaaagccactgggtaacagttttaatttccagttctaaaaaggcactgttgtgtctcttggaggaagcaatccttcatttgaaacagacttctaggccagcagatcataaagttgtagaatcaagaggcaaacattttgctagtaggtcactaggaataaccgtgagtgagaccactcccactttcttcccttgattcctggacctgtgaattctgccttttggagaaacagcatcatattttggatgctgatttaaagcatacagactcctgaggattctttccccagctcagtactgccacctggctgacactgtaactgagtctgcaaaaggccatttcatcattctaccaaaccagctacttcaggatggtagaaaacatagtaaagtcggtgaattccacgaacatggacccattgctgcacttcttttgctgttaactgaattccctgatcagaaacactgctgtatggaaaacaatgactgtggttaaagcattccgtaagcccatggatggtagcttgggtagaaacattgcatgtagggaaggcaattctatatccagagtgtctattccagtaagaataaaacactgccctttccatgatgaaagtggcccaatgtaatcaatctgtcaccaggtagctggcttattaccccaggtgcatatcaaggattcagagttggtctgtgttgcaggcatactgggccctcacagtggccatggccaggttggccttggtgagtgggagtccatgtaggctaagtctccatcctgccactatggatactttgttcctaagtctactgggagatgacagaagtggctggcgaaagaggctgataggtatccacagaatgggtcatcctatccacttgatttttaaaattcttctctgctgaggtcatcctttggtgagcacccacatgggacacaaatatcaccatggttttgtcactcattcagagaggtccacccacacatacctctttcccaggtttccttgtcaccaatcttctaattatgtttacacattatgccatttgttctttccaagcaaagtgaacaacctggtgcactatttgaagttgagtccactgggacaacttctcttcaccactgtccagggatgtcccagagaggggctacagtgctgcagctatccactttcagatggttcctgaatattatgcaaaaccctctgtaatccaggcccaagtcttctcttctttagtcaactgataatggggagctccccatgggaccataggtgcaggctgcgagagaaaggtcagtgtagcagatgtggggaccatgggcttttgggtcactttttcacgtaacttacttgtgcttcagagcctgctcagacctaatcatgtgtataccacttccattagatgctggagtgctcctctgcatgcctagcttcatagcttggtgaatcagataacacccagctcatcacatgcagctcagatcacatggcaacttggtggcccagggttacgagttctgtaactactaaggtctagtagcaggccaagagttgtttctcaaaaggagaggagttattcgcagaagatggcaggactttgctccaacattctaaggccctgcgctgttactcacttatagggcttgtcaaagtctccaaacagtatcctatctgccactggcacttcaagcaccattggatctgctagatcatacggcccaagcagcagagaagcttgcacagcagcctggactgctacagagcctcctcttattctgggtcccactcaaaagcagcagttttctaggtcactcagtagatggctcagagtaacacacgcaaatgaggagtatgatgcctccaaaatccaaagaagtccacagggtgttgagtctctttttttcgttgtaggagagaccagaagcaacatcaccttaaaaggaatatcttgatgtgcccaacatcactggacctctcgaaattgtactgaggtagaaggccccagcattttagttggatttattaaccactccctgacatgtatgtcttaccagtaatgccatcagtgtaatggaccagtaatatcttgtggaagtaaaaggtaatcaagatccctgccaactaaattttaacatcggcctagaaagttgacatatctgtgaggcaggatagcgaagatggattgctggccttgtctgctgaaagaaaattgcttgtaatgagacttatgaacagatacagaggaaaaaaagcatttgtcatgtcaatggctgcatatcagaggatgtgttaatttattcaacgaaaccacatctgatacagcagctgcaattggagttactatctagttaagcttactgtaatctgtcattctccaaaattcatttgttttctgcacagttcaaataggtgaattgaatgggggatgtggtgggaatcaccacccttgcatatttcaaatccttaatggtagcattaatgtttgcaacctctccaggaatgcagtactaactttggtttactactttccaaggcagagacagttctagcggcttccatttagcctatctcaccataataacccttgtcccttacacaagttaaggaaccaatgtagggttcttccagcttctgagtatatctattctaatcatgcattctggaaacaagaaataagcacaggatggatttcgggactcactgggaccactgtgagacagacatgggataaaactccctgaatcacctgatctccataagtccttactttgactggtgacccacagagggggtttaggtgtcctggaattagtgtcagttcagggccagtgtccagtagtttctaataggtctgattatttccttttccccgttgcatagttaccctgctaaatggtaccttacttttggggaagttgtgaggaagtttaacagtgtaattttttttgcattgtatggtgctccttcctcaagagtacttggcctcccctccagggggttctggggctataaactggctctaatctgggaattgattgaggagttgtgactctggtctaggttaaacttatattcacttgacctaggaattttctgcttacccagtgatacagtttggatatatatccccagccaaatctcaggttgaactgtcatccccagtattggaggtggggcctggtggaagatgactggatcatgggggtggagttctcatgaatggtttggcaccattcccttggtgctgttctcatgagagtgggtgccttctcatgagatctggctgtttaagtgtggcacctaactctctctcttttgctccagctttcaccatgtgacatggaagctcctgctttgccttccgccatgatcctgaggcctctccagaagcagatgtcagtgctcatgcttccttgtagaaccatgagctaattaaacttctttccttataaattacccagtctcaactatttctttatagcaatgcaagaacagccttatgtatacagagaaagtaagaatttagtagtcttccagagtatttcacctctagaaccatcatgctcaactaaccaacaccataaatctgcacaagtgagatgattctgattgctgtcttgagtctgcctcccttacaggaaccacacccactctcactttggtaccaccctttggctcctgtcatcctgggatccaattactcccactgtctagatttcccaaacagtgactgcattctccactgtaaggtctggcaatcacaaagctcttcagagacgctgaggctctccttacaaattgatttctcacaatagcagtgaaaagaagtacatcttctgttttctcccaatgagggtggttagatctgaaatggcaaatctattctaacattctgatctccctaagcctttgatgctttcctctacagatggtcccctttaagatggttcctgttgcaatggtgtgaaagtgatgcacatttagtagaaaccacactttgaattttgaatcttgatcttttcccaggctagatctgctgtatgacactctgttgcaatgctgggcagctgcagggagccacagatcccagccacccacaccatcacaagggtaaatgaccaatactcagctgcgtactgtgagtgtgctgtgttgccagtggtttttattttttatacttttaatgttttaattttttcttatttttcataagttattgggggtacaggtggtatttggttacatgagtaagttccttagtggtgattcgtgagatgttggtgcacacatcacccaagcagtgtacactgtaccatatttgtagtctttcatcccttgcccccctcccacttttccccccaagtccccaaagtccattgtatcattttacattctcaagcttcatcagaagagagagaaaccaataaccctgtcactataacctctccatcagccagcaattaattttagttcaatgtttcaaactttcttcaggctccgtgcactttcagctgtgtacattaatggttagtacccatacaagtattctgtttttcactttcagtatggtattcaataaattaggtcagctattcattactttattataaaataggctttgtgttaggtgattttgctccactatagaataagtgttctgagcatgtttaaagtaggataggctaagctatgatgtttggtaggttaagtgtattaaatgcagtttgacttgcaatgttttcaagttatggtagctttattgggatgtaaccttatagtaactagaggggtatctatacattcaaccaaggcaggtctggcatttccaacttactcactgtaggccaccttttggtctaggctttagtcaaccacagaaagtgttagagccctttctgactcctgagatgcacattaactgtataatctatgcttagtagaagtaatttcagcctgaggtaagttggtgttcctccaccaatatctcacacacttaatatccattctcacatgtttcctaggtttctgtctgtataattttaaaaactcaaataattattgtagagtgtagcacacctcctcatgggccacactttatacctcacctttaggggcccgctgagatgagtctagttctagatccagaagcaaagaaagatggtaggcatggttcctgagaatattcagcattttcttgatggcagcttcctcaggggaggccactaaaatttcatcagtcactaagaggttactctcttcaaatgggggtagagaggctgctccccctggggctggggagacatcttccagcagaaaagaacttagtggttcagtgtttccagcttcatccaggtcttccctcacatcacatccccactccaatattcagattccattccttcccaatcaatgccctcactttccccataaatactctacaaggctgggagttcaaacttacattgtaattcagccagtcacaggatgagtttctgggcttcattttcagcaatcttagaactgaaattacaggagataaatgtctccttcagggcacacatagaagctttcagatcatttaggtagcatttgagctgggaattttaatcgttaagctcatctttctctttctatactttgtccagcaccattaggaacaatcagtcctaaactgttatattcaatagcttgtcggaaatgtttgaaattaccatatacacagtcatccatatccatgctttttgtaagtagttgattaggactatccaagggtgatattttgcatatttctattgccaaatcatgccaggtactgtgagtgctttctttaccactggaaacagaaccactagcatctttaattctaatcagattagaaagccaattctggaaacttcagaacaaattcaagaaatttattcttaaaattttgtttctctagaaccactgttagtactaaatcatgctaatctcagtactaatctgtattagtcacgtaccttccaaaagaaaaaaaacccagaacccactagatgctcagatggatatgtggacacataggtacatttattgtaagaaattggtttatgtgattacagagactgaggagtccaaaatttgcagttggcaagctagagacccagggaagttggtaatgtaggtccaccccaattccaaaggcctgaataccaggaaagctgatggtgtaagttccagtcccagtctgagtccaaaggcagaaggacactgatatcctgttcaaagactatcatagagaaacaattatttattactcaaactttcattccattcaggccttcaaggaactatatgaggtccacctacaatgtggagagcaatctgctttactcagtcatacctgggaggcttcaagacttccaagaagggtgttaaacttccttcagacatggaattaaattttgattcaattttatccaactgtcttgggaaaaggggaatgcttcacctactggatggtttaaattattttgttgtaatcattataaaaatatgtacatctgtggacaaaaagaaacaatgaatgagccaaatacatacttggaaattcacaaaaatgttagttttatatagacataatctgataagcttggaaattttaaaaaaatgcttttcgaataagctcagtgtttacaatagtcttgtttcttttacttgtcaaaggctctgccatctgaaagtattcaaaccatgagtttcatgggccctgcctgtgagaaaatgtgcattttccacataaaatccatttccttgtcagataatttacaactcaccctgtttaaacagactctgtatttaaagctagaagatttatcacgcagcaagttcaacctcaggaattccatataagtccacaagcgcatgtgtctaaaaactgttgagtaagtaaattcaatgatgaaaactgtaatttatatcaaggatgagaaatactctctttgtaggtctattgtcaatgactaatatatgaagaattaatgcagttgatcatctaaataatgctacacatgtctgtttccattggcctgtggacaagaacatgtgtcagtaaaaaaaagagttttgaaataaatctcagatattatgattgtttcattttctctaataaaatgtgaacatttattcattcttggaaaataattttgaatagaggtatattcaggtatatgtgttatattcctttgttaactttataggcattagtttcattaattaaatataatgtggctttggtggaatgaaaaaacactagcctgaagctgaactggtcacttttcagttttgtgtttggtgggtgtggacagacatgatgtaattctttggagaattgagacaacttgggagatttacagggcacatgtgattgtatttccattagtgaaattgtcacacattaaagacagagtaggcatattagagctaaaatgtattcaaaggacctttatcaaataaatgtcagttgtggaaataaatgttaagctggaatatgtgaaagacaaatggaaaataaatggagaccattcattcacggacaggtagagaaacattcagtgaaagctaaaaagattgaaatagggtcggctgggtgcagtggctcacgcctgtaatcccagcactttgggaggccgaggtgggtggatcacgaggtcaggagattgagaccatcctgactaacatggtgaaaccccgtctctactaaaaatacaaaaaaaaaaaaaaattaggcgggcgtggtggcaggtgcctgtagtcccagctactcgggaggctgaggcaggagaatggcgtgaacccaggaggcggagcttgcagtgagccaagatcacaccactgcactccagcctgggtgactgagcaagactccgaccgtctcaaaaaaaaaaaaaaaaaaaaggaagtttgaaacagagtcatgaaaggcgatttatttgttttcagataagtgacatttagataacaacttgaaacgttgataggaaagttccagtaggatgggaatgattgaaagaacaagagagtagggaaataattgacaggagatgccaggaggtggacagagagcacaagtagacagattttactttcccggagggattcctcaactggattggaagggaaggcaacaaaaagtgactgggacatagcgtgattttaaaggcagaatacatcaaaatctgggggtagttgatgcagaagactttgaacaaatgtgaatatgtctttatggaatgttcccatcctacaccaatataagtgtgctgctaaaccagagagagctctctggaagggacttccttgctagtgttacaggaaaggggtccctatacagaccccaagagagggttcttggatctcgtgaaagaaagaattcagggccagtccacggtgcaaagcaaaagcaaatttattaagaaaataaagtggcgaaagaacagctactccatagacagagccgggagttcccaaaaggaagaagaggaacgcgtccaccctaggtacgacacttgtttatatataggataaataaagatcatgggaagatgtgctatgctacaagggtttgtgataaaggattaattttcttatgttttgcaaggatcgatattattatctttaaagcaaaattaggaatgcttctgttctcaagatatcaggatatcaagacaatcccaagtctgggccagtttagtaaacattatcaatctgttctcttagcagtaaacatctagaggctaggaatgcctaactttctatgaatgcagcccagcaagtcccagccttattttcttagccttcactcaagatggaatcattctggctggaaagcctttgacactaggaaaagcacaaattgtataagtggaacaatttggaaacaagtgtcaggtagtctttctttagacacaacacgactttgacataacaattgcaaataatgctttgcaaccatgtcaatagtggtatcttgaggggaactacagaatttgaaaataaatgtactctttacctaattactaattttttcatttattcttatgtcttacaaatatgattatatttatttaggaataaaaatttgtttcttaaggaattcatctatttttgttgtagttcccattggaaaacacatttttttttgttagaatagtataatcccaataagtgacctgtattcatgaaggctaagaatagaaacaagtaatggtagctcagaggctcaggttggaacataatggctctgcctcctgagaagagggaaggtctaatattacattagaccacatgtggcatctttatatttgctaagggatagttagtgcttgcatttctcaaaacaggcttacattatcacaatcggcgttcaactagttcaaaattcaagcttagtggatttttttccacagtagtcatgctaatgtaaatagcacatttgcagtgaaaatgttccagttttattcttaagatgttttagggcagtgcttctcaaattgtaatgtgcaagatccttatgatcatgttaaatgcagattccaagtcaacgtaggtgtaagtagggaagtctgcatttcaaacaagctcccaagtgaggttgtgccttgcatagtaaagttgtcgtttgcagttagatacccgcttaccaacagaaagtgaccagttaagaaggaacacatgctcaccaaatgcttatctcaataaatttctttacacagacttattaaaatcaacttaacataggatacacatgacacatataacatccctgtctttagaaaaataaattgattgtttttatgtctgacatatatgccaaataaatggaaaactgaagataattttttggttaaaatttggtcttcacattaaaattagtttgaagggtatttttctgaaaaaagaatctctctttctccatatatataatatttaacatttaactttaatttgaagtaacatttgcaagaaccaggctgtaaggtagtttccagggaccaaattgttaaaatagatgtttgtaatcaatacttaactgatgtgaacattttgtattatgacattaaagagggaattcttatttgaactctgcattagctgaaagttcagtgcattctgtagctttcatatgaatttcttccactacattaggttctagattttaatatttgtagagttggctgcatgcagtagggaaaatgccttttgctcttagaagtcatgagaactaaggggtcacaaggcgaattagtgcatttaagccagatttcatcctgtgaaatccagcagcagatttttttttttttttagccaaatttagttactttaagaaacaaagaatagaaattcctttaacaaagaaaattctgtctgttaatgtagttgacataaagataataagatattgaattttttaatgatttctttgagtctaggatgtgcccaaggaaacctgtcccttggcaggaaaatagtagacattttcttgaaattatcgactcatgcaacaacttggataaatctcaatggcgttatggtgagtgaacaaagtcattcaaaaagttcatactgtattgattccattatatgacattctcaaaggataaaactatagggatagaaaatagatctgtgattgccagtgcttggtggcataaggaaggctttgataaagaggcagcatgtgggaatttttttagggtgatagaaatgtatcttattgtggtgatcgttatatatatgtcttagaatttatagaaatgtgcaccacaaaaaggtcaattttactgtatgataattataaaaacaaaagaaaatagaaaaaagtgtgagacaaaaaatattaatttacctcagaaactaaatgagattttcccattgtatggagctgaggatttatgaaaattgctttcttccatatgcagccaggcatgaagctgacttgtgcctccattccctggaagaatccatcggggaaatggtggtaatagaagatgtgactctgtttgctggatttagatgccattacttcaagagcacagagtgcttcatgtagttgcagacagaaactataatggaaatattacttaacaaggtatcactttatatttcttctttcttttttttttctttttttgagatgcagtctcgctctgtcgcccaggctggggtgcagtggcacagtcgaggctcactgcaacctctgcctcagcctcctgagtagcttggattacaggcatgtgtcaccacgcccggataatttttgtatttttagtagagatggagtttcaccatgttggtcaggatggtctcgaactcctgacctcatgattggcccacctcagcctcccagagtgctgggattacaggcgtgagccaccgcgctcggccactttatatttctttgaatataatatcccaagtaagaatttgggattgtggaccgggcatggtggctcacgcctataatcccagctacttgggaggctgaggcaggagaatcacttgaacctgggagatggaggttgctgtgagccaagatagcgccactgcactcctccagcctgggccacagagtgagactcggtctcaaaacaaaacagaatttgagattgtgtttaaatatagtaagtacatttgataatcaactgcatggcagtcaaatcttaaattctaaaaccactacatctctgagtcaaaaagttgtatttgtggtagtagtctaaaagaaaaattctcaccaacaacacctcagggcattgtaaaaagtgttgctgattcttttcattagggtgataattgctaattaaagcctaatgtatggtggggttataagggctttctttccctccatgttggaataaaacacggtgtaaggacaaagctggtgtatattaaattagccctgatgcagactggctttccatattccgtataaggaatctgaggtttattttttattttatttaatttttttctgagatggagtctcgctctgtcgcccaggctggagtgtagcggcgcgatctctgctcacctcaagctccgcctcccgggttcacgccattctcctgcctcagcctcccaagtgtctgagactacaggcgcccgccaccaaacccggctaattttttttttttttttctgtatttttagtagagacggggtttcaccgtgttggctaggatggtctcatctcctgacctcgtgatctgccctcctcagcctcccaaagtgctgggattacaagcgtgagccaccgcgcccggccaggaatctgaggtttagagcgttgaaggaatttgcccaaagtccaggcactggactgggttctcagcaagagaagccatgctgagaacccagtctcataactccaagcgtgtcttgacacagtcaggtactccctgctctctgctaaaggaagtgagtagttaccatcatttagtcatccactcattcaactagtatatatcgaatagaacttaggtgacaggtgctgctcctggcagaaggcgctgttctgttaatagatgctggggttgtttctctcattagaaatatattaaaccttgtacaaaaacaaatgtcttcctttgagtttcctttgcacttccagagtttagctaaaaatgcctatcaagtgaaagcagttttctgctcggaatctgcaaataaacgtggattctgagaattattattttagaaattaaatcttcccttcagttatgtataaataacttgaaattactagaaattaaaatcaaagaaaatctggaattactgaaaattttatttggagtttattaaagaatgaaattatacacacacaaatacacatatacacgtatactaataaaaactaattctttatatcatgccaacaaaaagtaattctattgtttctgttcctacaacacctagctttactatttaattttatgttaaattttgattattcacatttaaacacaatgagagtgctttttggtcattgaaagaacatgatagtatcataaataaatattgtaaaatattaaatattactactaataaagaaactaaataattaaaatactagtaaatatggtctcaatcattaaatgtaatgacaattttattttgatccttagcccagactgatcttttcatacaacgtcgttagaaggcactttgatttatattattgtttcagcaccatgctggtagtacctgctaggaaataagcaacttcccacatcagaacgggcaatgggaacaaccagaagccgcatggagatctggcacgggggccagcgagggcagaacgggagtcagcattgcgctcatggctctccaagagggtcttggcggtggagcacctgaggaaatgggagagttagccatgaggcctggtacaccagcatttcctccacctttcctatatgccaggggatttacaaaagatttttttttataggaacaaatagactatttatatccccaacaatcacctttttttttttttttagacagaatctcaaagtcagttttcagaaagtatgtgaggatttattgcgttccaggtaaaagcagctgcccattacatgaaatctttttttttttttttttttgagacagagtctcactccgttgcccaggctggagtgcagtggtgcgatctcagctcactgcaacctccacctcctggattcaagagattctcctgtctcagcctcccgagtagctgggattacaggagtgcaccaccacacccagctaatatttttgtatttttaatagagatggggtttcaccatgttcgtcaggctggtctcgaattccagatctcaaatgatccgcccacctcggcctcctgaagtgctgggattacaggtgtgagccacaccgtgcctggtgcaccaatcacctttgacacttcatattatagcagagaatgtctttcctcctgattattcaagaaaaaatatataaatgtatacattcatttctatacaattatgagctaaacaatactgaatatatcttactagatttaaataaaatttaagtaacaattttatttcatcatttctaatagtacgagttaaatagatactatgagtagaatttgttgtatggataaatggaagtaagcatggatatgtttgtatataataaaatacagtcagcatgaattttatccaatttttaaataaacatagagttataaattaaaattaaccagccataccaacccatttgaatctatagtttcctacaagggaatgaaatgcgaagtaatagcgagcctccaaatgttttagtcacgcagtgtagagcacccacaaatcatctcacccctctgtcggggggcgctgtggggtgccccggctttactagtagtgcttctctaaactcatgcctgcaccctttcttctggaagcctgaacaatgatgcagagatactgttttctttgttgtagaaaacagcagaaggtctgtgctcacgagggcaatattaggtcctcatcagctgtggcttgctatctccagcacatcaatgaatggagaaaataagatttaaacaaagatcagtgtctccattctctaacattttactcaaaatattggttaggttagactccacacccaccaaaacccaaaagacattccatctcacagatgctctacattctttcaatacagaaaccttacgacaaagcctacaatatacacttgttttagtaaaataattggtccagttagtaaaaaatgagttgaattagtgttctccctctcacacattataactataacttttttcaattacacaggtgtttacagaatttatctgaggtgctttctgtgtatctctgaaaacaccttcataacagtaggcacaccctggctagtggttctcagccctggctgctcactggtatcaccaggagagctctggacatactgaggcctgagcccttcccccagacactaatttaatgggactgtggtggggcctgggcatggatgtttttagaagcatctgctgatagataagcaataaatacgagtttattaactacacatggtgatttgatttccatggattcttccctgattttctgatccattggcccgtatatgaacaggctaacttctagtgtgtgaaaagactgacaggatattaacctggctaagtgtctttgaaaatataaatggagggaccatgccttaaaagagttatgaaaaaaaaaaaaacagaaaatatgcacctgagaggggcgcaaaggaagcaggcgaatgtggggtcttggagaagtcactcctgatcttgagtttctatgagtacacattaaaggaagtcattgcagttttctatgtactgtgcatttggatattttcacaaactgaaacaataattcgctgcttcgggaaggggaacagataatgtgttctaacgtagcatctttactttctctattattagaaacattttaaaaatctatctttctttggcttggcatggtggcttacagctgtaatccagcactttgggaggctgagactggcagattgcttgaggtcgggaatttgagaccagcctagccaatatagtgaaaccctgtctctagtaaaagtacgaaaaacattagctgggcgtggtggcgcatgcctgtagtcccagctgcttgggatgctgaggcaggagaatcgcttgaaccccagaggcagaagttgcaatgagccaagatcatgccactgcactccagactgagagatagagcgagacccccatataaaaagaaaaagaaaaaaattatctttctttggagtctgtcaaatgtattaccactttattattagtgaaatttggtgagttatatcaaatgatcagtgataggagataatatctacaagatttaatgattgactatagggaaggagaagagaaaggaatagatttcttcttttttttttttttttttttgagacggagtctcggtctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagaaaggaatagatttctaagtcaaattccattgataatgatgagaatcatagggggaggagtcaatgggtaggagaaaaaatatttggtttaggacatgctgaatgtgaggagcctgtgataaaggataggataatatgaaaagcttccaaaaggagtacaccagattatgagatctaccttttccccaaacttataaagggaaaaaatatcaactccattgttaattctccattgatcctgatgaaacgtcagtactactgatgagatgtaaaaataaaaagcagcaagactaaagttctccaagattcctctaggatatgtttggtgtctgcatttgcatttattgttatttaatctacgttattcaagatgctttctatttggaaccccaaaacaaatggttgaatgggcttgctctgactatctatttccacagaacaaccacccaaaatttagtggcttaaaaaaatgacagcatttattttgtttatgaatatgcaataactccgcatggtttggggatggctcaaagaccaggggcgaggatcatctgcaggctcatccactcacacatctagtggttgatactagctgttggatttccacgtggctcttcagcttcctctcagcctagtagatggatccaatggtgagtgtaccaggagagcagaagggagccaggcataggtgtctggcctttcctaactgagctgaggaagtcacatggtgtcatttctaccatattacagtcattagaagtgagccagtaaatctggctcatattcaaagagagggaaattagactctatttttaaataagtgtcaaagaatttaagggcatattttcaaactgccagagcgatcgcagaaggctctgccacctacaaccaactatttctttgcattttaatagaatttttaagagaaatcatagctgaagctgcggttatattttggagtcgtcacagtaaaagaaataaagtacatgtaatttgatatttcagagcattttttccctttgtccaagacattttaaatttgaaatatggttttggcagttttgtaagagatattatgtaaattgaaaggagaagatgagttttggagtcaatcttaaaaattcattttggagaagcacaacatttgcacagcatccgtctgatttgatgccgtttgtataaaagagccgtgctttcccaggagtggaaactacattattggaaaaatataggctccttagggtaaatgatagcacaaagatagtaaatgtcttttcatttgaaataacctttgtggaaatgctattattctcaatatattgtaaaagagatgaatcagaacggtgttagaaactatttaatggatcatctatctgtgacatattacaaagctaaatgttgaattagcacttggctaaaggaggcctcatggccagaaagggttcagctttggaatccacaactctggttttgaatcttttttttttttttttttttttgagacggagtctcactctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggcctggttttgagtcttggtttgacttttctttgccgagagatcttgaagttttgttatgaggattagagcacaattcctggtatctgctccctggctgacactcagaaactgagatttgtcattaagattgtgatggtgagatgatgatgagaaattgtttgactatctcaggaatagtagaaattattaaaatattgaattgtacccatgagactatgtggccaggcaagaagaatgagataggccctttcttcaaagtatatgatttttttattattgaagaaattattcataaacacttgaaaacaaagcatattcaaagttttaaactgtacctaaaagatagtgccataggagatgtgagattttgctaaatattttgaccttaaaatgggaaactcatgaaatatgaattattttaagggtctaatttattgcattttttgattcatatgaatttccctcgacaatgttaattcagttatcaggacaaatgaaaaagtaagctttgtaaattaaaatacagaaatatttacatattgtggcttgtctctggaacttttataatgggatattatattttaacataatgttgatgtaaaatattataaccaagatatcagcaatatagttacaagttgttcttttgaaacacagggtcataactcacaggtacctgatttcaaaatacttttggcataatttacaatttataaatctataatctctttaaggcgaattgttctaatgcataattaatgcactagtgccatgactaacttttaagaatgctgcattttccacaccagttcactgataacctaaaatattgcagtcattcttttaagaagttgttaaaaatgtctctgtaaaatataatggcaaatgctggctattttatgagtgggaattacaatagtaaatagtaaaacaaaatattttccaagaataaatgtgcttcatgtgggtttgatcagcacatctgattgaagatttgaggtgagatacattgtccccattaagtttaagggtttcagcgcaaaatcagctgatctactctttgaaacgcagggcatttgtgaaaatgccaaacgcatctctattagaatctcatccatgagcaaatgagtaatgtaagtcagatacaatggttaattctgtggtttgccaaatctgtacacttcctgttactttgtagattgtaaaataatgatgcagcattcaccctaatgatcaattgttttccttactaaaatgtaagcatttaaaagatctgcctaattttttctaagtgtatgttaggcagatctatacttcctactcctaaagcattcttctaaagcagtttattagagcgcacactaatggcttatcaattaagcaaacatgatcagtattgagcacttgctctgctccagggtgccggtgctaggttcacgtgcatcagggagacagagttatagtcctcatgaagcttacaggggggcagattgattgaaccgacacctctgattcccttttaagcctgtaagcagctgctctgtaaagcaggtgtttcaaacacaaccaccttcagagacgaggtgattctgttgagtgggtgaagcaggccaggcatgaggccgcaagcagtggtttagaccagttcattggagaatccctgccttattaaaaatatttccttccaaaaatgtgaaaggaagacttgtccttttccccaaatcatttagaaagcttgctttgtcacctctgcttctaaggagtcctggttggtctccaaaaggaagctttctctaaagaacagtgtagtacaaagtaagatgggacaagactcagggggcccactcctgagctgctcagccacttgcccacctcaggtaaacactgagcctggtggtctttcagtcattccaggtctgatgttctacagttttgtcaggttatctgggagaaattttgatgctgaagagtcccgaaagtaggagaagcatttcaaactgaggcctaagatgttttcaagttgtggcagagttgccttgaagaaggtaactcgggctttgccctttgcccttttgccctttgccctttgccctcacctgcagcctgcacatccatacctcacctctaatacagcaacccctgtttgacatgttgtatatattaagcttttacttaagatgtcatttaatgaaaaagattttgctgcttaaaaagcagtggagaataatagctagcctcttgagtacacagtcccgtaagatttgagcacatgatttttagaaaaagaatagaaaataagagaaaattataacctcactttacctgtcgggatattgacatcactgtcagatttcacaaagccacatgtgcatctggtgaaatcccagatccaccctttctaactgtatgctcttaggtagccaattaatctttctaggactcagtttttcattcattaaataggaaacttaacacatagggcttttgagagggttacatgagtcaatacaagcagagaacttagtacttcctctgtcacgtagtaagcactccttgttatccttggattttgtggtactttggaggagaatggcactcggatctctgttggtataatttttaccaaagtaaaatctggttgaaatagcattcagatttaggcttaaggagaggatatttcttagaaaggaaggctaagcttaatgggggaaaagagttatcagtgaggccttggggcaggggactgactccactgggcattacttgtgcaaaagggataaaatgtagagagagtttttttttctggtatattattttattccattaaagtcagtgttctacttttattttgtaaaatcatatttctgagtcctgaacaaaagactttcaagatagattttactgacagagaaatggagtgccacattccatagctttgcatatagagcttcacatgcaaagctctttgcatctcaagggctaaaactggctgacttacagcaagtagctttcctgtaaactgtaaagtagaagcgaacggagacagctatgaaggtgggaaaaatgcctcctgcagaagaagagcagacataggggagcataaatagtataccctgcctggaccctgagaaggacccagacctgcatgctgcatattgagacagacatggctgtggattctcattacttgggattctcagtgatgcctcaatccacaattttgtattaataaaaaagtctttaaaatatttgcatctaggaatcaaagtgtcattcaatgacttattggtcctcaaatgacagcttggggttgtactttatcttctatatcatggagtaactcctacactatattcattccaggagaattaactatgtcaattcttatgttcatctcttccttggctgattatttgttagggaaaaagcttttgcttgtttattaatttgtctccttcctactcttctgattattattttgtaatcaaaacaggattttaaaattcatagacactaaaatattctagacttttagcactggtttctaatattttgggaggagaagcttcattttttcttgaaaatgaaggtgtaaagatactaaattccttgagtggaacatctgggcttcatagaaactttggagctatatgatagttagagagaatgtagacagggttcctcattgtatagataatgaaactgtggaccagagaggctgagtgacttgtagaaggtcccccagtgagtagcagatcctggatgcatgcagcattgctaactctgagagctaagtcctcatcatgtccccaccttcaccacaccacacagttcaggagaaggggcacatctctagaatatggctggaaaatacactagggaaaactttagatccactagcagagtccagtgctcctcttggagaaagtgaccagaaagaataaagcacagttagctgttgaagaaaagctgatttctcagccagattatgtacattagcatccatgttagttacctttgctgaataattctctcctcaactgagctctctgaagaaacctccaggaattagcagggctttgagtagagatggcatatgtttgggccctgatgaaaatgataaaattgtggcctggttgcagcttgtgtgctgaaggaagagcatgatgcagttcattggtatgaaaaatgaatgcaactaaaacctaaacattaaaacttggcctttattaccaaagtgaaagtgcttctaattgaggctccctgggttttaattgttcttcaggaaaattagatgttgtcaaagtagaaggttaatgtctgttcacagtctggagtttttggaataacttccttcacagcgtgtgtgttttaaacataaaaagggctttttggtttgtatatagttagtgggattacaactgcctcactagatgcttacaacaaatatttaagaaatccataaggtctactatttataacagaataaacatttaaatttaagatattttgaccattttggtaaaacatttaaaaaataaactatcatgaactgacaaaaccaacatcatttaaaaaaattcaacatggcaaaaactttatgagacttataccatagaccaaatttgtaactttagccttgatacattactgcttgtaaatagaaatgttcttactacaaagtgatgtgctcagatacacccaaaatttattaaaggcatgtcaacagccaaattctgtggtacaaggtttttcatacattattttacataacctttgaggaattccaattttatattcccattttcagaagagttggttagttactgaattcaacaaatgagtgtgagcaggggcctggagtacttaaaaagaataaacaaaatgcctttaaatcagaaacacaaaattgctagtaatttcagttaattgcactttactccatgtagctacaattgtagatatctagaaaaaatatctatgataaaagcctgccatctggaaaagtcaaaagaatgatgagctggtattaaatctcagtaaccctgacatatggaatatctctgccatgttaaaagcagaccttggtatgagactgactctgggctttacatatgaatttggaattgccaatatctctacttgaactatgtgagacaataaaagtgctcccttatacactttagataatgggccctttgggggatctgatgttcattcagcctttcccagaaaaatacaactataataaaatgttgtaatcagtttcagtttatttattgctgatcttttatttttgttttaatttaacatggcaatccactttctatagtcaaaagtgcaatttaaagaactctaacaacttcacaatctagaagaatgtctttggaaattttaggattcaaatctaaaacaaattttgagatttctttttcctagattgtactgatgttataagtgccttatgtaatacccagttcttccccatggagatttctcagtgaaagaaccacatcacatgttcacaagagcatcaagaataagagggtcaggtacctaggaagaaagattggctagcattctctctcccccatcaaatataaatggatttagcacagggattttgtttaattcactactgccagcacctagaaaaatgcttgaaatttttaatatgacaatgcacaattcaagaggaaataataacattgtattagtctgttctcacactgctataaagacatgcctatgaagtggtaatatatgaagaaaagaggtttcattgagtcacagttccacaggctgtacaggaggcattgctggggaggcctcaggaaacttaaaatcatggccaaatgcaaaggggaaacaggcacatcttcacatgactggtaggaaagagagagcggggaggtgctatacacttttacaaccatcaggtctcttgagaactcactataatgagaatagcaatagcaagagggaagtctgctcccatgattcaatcacctcctccaacattgtggattacaattcgatatgagacttgggtggagacacagagccaaaccatatcaaacattagtatgtgaaagtagttattatgataaaacatattttaaccaacatacaattagttatacgatttttataatgttttcagtgttaaaatttttgaaaaaactgcagaaaaacaagtggaaatgaacaaaattacattgacagtagtaagttgtaatgtttaattctttgaatgtttcagtgggagctagaaattggtttgatatactttttagttcagttggaatacttaacacttctccactttgcctaatatatgctgcagcaataaattaattttccttctgagatttctagtaatttggggagtgcttatttgcaaagaattgaaaaaaaaagtgacacaaattgatatatcacgcaaactatgtggttttgtattttcaactaattgctgaagagcacttatacacaaaaaatatcagattcctcaaagaggagatatttaaggcaagcaaagaaatgtataggtcagtttccttcaaataattttatttcttactcttaaaaatcttttatttcagattcaggggctacatgtgcgggtttgttacatgggtgtattgcatggtgctaaggtttgggcttctattgattcccttacccaatactaaacatagtacctaattggtagtattcaaaccctgctgccttttctcccaccctatttttggagtccccggtgtctactgttcctatctatattttccagtgtttagctcccacttataagtgagaatatgcagcgtttgtttttctgtatctgccttaatttgcttaggaagtggtctccagctgcattcatgttgctgcaaaggacatgattttgttctttttacggctgtgcagtattccacagtatatatgtaccacattttctttatccagtccatcgttgatgggcacctaggttgattccatgtctttgccattgtgaatagtattttgataaacatatgagtgcaggtgtctttttggaagaataatttatttttctttgggtagctacctagtaatgggattgctgggtcaaatagtagttttatttttggttctctgagaaatcatcaaactgctttccacaggagccaaattaatttacattctctccaacagtttataagtattccctttctctacagccatgccaatatctgttgttttttgactttttaataatagccattctgactggtgttccttttgcccactttttaatgaggttatttgggttttctgttgatttgtttaagttctttataaattctggatatttgttttttgttgggtacacagtttacaaatatcaaatattttcaatgtagaaacttggatctttgatttttatgatgataaattgaggcatattgcaagaaaaacatttgaatcagaatatttaccaatattatcataatagtgaattacatttttacttgtccctacattttggtaataacaattaaattttgctaaataataattaagtgctggtccaagatggtggactgattattcttccaggggaccaatttcaatgacaataaatgagaaaatgatgtgaatcagtaacaatactaatttaagctaatttctatatttctatggtgtacatgttctttgaaacaacaagtatctatcgctgtaagaataagacatttggaaaatgtcttatatatgtgagatatgtcatatatatgtatgtaaataaaccataacctttctatggtatatgatgtgagctattttcaaatatgtgagttccaacttccctctgttaaggaacatttaactttgagtgattcatgtgacttctgagaccagctgtccccagcctctgagattcagataaaaacaagtatccttagctctagattaatccagtggcactgagcatctatggtgatgaaggatatgttttcggtagtcattttaccaaagatggtgctgtgaaaaccatcaaaatataaatcatggccttaaccatctatctgagaagacaagactaatacacttgaaacacaagaaacaaatgcaagataatatacatatatttgtcattgaattttgtaatacagcctacaaatgttatagaggctcatctaaatgaggaagtcaatgatgcatagtataatcaagatatgcttcctagaatacattgtgtagatggatttgaataggcagatggataaagatgaacatttaagacatgagcaaatgcctacacacctgaaaaaatgtggcaagtctgtataggagagaagaacatatctgagggcttgagctacggtgtgataaggagctcatttgaataatctggtggaatcagatgggctatggaagcctgatggagtaacacaagcagataatcaacaaagatgcttatcagctctaagaaggaatagaaaaaaatttcagaatataaaccatggaacatgtctcaaggaaataatttttatatgtataaaatttaacctaaatataattctataatgtaaacagaaaaaaataatggactggaaactattttcatcaaatatgaacattataaattactatcatgtgttactcaatgtactttaaattttagacattttaaaatgattcaatttttcaatttgtctttaaatttatatataatatatttgagatataaaaaaaccaaactgtttttcttagtctcacacactcaccactcaatacattacttcacctctggtcaccaaaatatgtatggatttttccccgcatgcaaagtaattctccagcagacaccactagggtggcctattattgaattcaattctgacactatctacttggatatagggtcagatcccacacagtaagggcacagtctcacaagacttcccttcacttcagatgccaactgcaggtcccaggatgtgacctgtacttctggccaactggctataaattggaggttcccattaccccctgtttaggttcaattaatctgctagaatggctcacagaactcagagaaaaacattatttacatttactcatttattacaaaggatattattaaggaaactaatgaacagttaggtggagaagctgcatagggcaagcttgtccaacctgccttattttgttgagattgttgttgttgtttttgttgctgtcctgttttgttttgctttagacttttagcaacctgaagccatggtttttagtttctgtctatagtgataagcagaaaagaggaagaaggaaggggctttactggcccaaccgggaacagaaactaagaactcatgactgtattccctcccttggacatcactgaaggtgtgagagaaggggtagggagcttccgtgccctctctggtatgccaccctcaggcacctccatgagttcagcaattcagaagctctccaaactgattttggggttttatgaaagcttcattatgtagaaatggttgattacatcattggccattggtaatcaactaaattttcagcccctttcctcttcctggggaataaggggttggggctaaaagttcttatcctctaattacatggttggttttcatagcaatcagctcctattctaaggctatccaggagcctaccaagagtcaactcattagagcaagagatgctcctataatccaggatattccagggatgtaggagctctgtatcagatactcctatcactcaggaaattaaaaagttcttcggagctctgtgtcaagaaccagggtcaaagaccaaatataagaacaaaagatactcctagcatccctatctggcaagggttttagaagctctgtctcaggaatcagggacagagaccaaatacataatttttattatatcacaatatcacatggcataattcacttttatattttgtatatagttcaataagttttaccaaatgcatgaagtaatgtagctaccactacaatcagtaacacagaatagtctcatcaccacaaaacaactctccctggaatcccctttgtaagcactctctactgatatgtaacctctagaaaccactgatctgttttctgctcctataatctggtgtacttcagagtctcagaaaaatgtgataataggaaatgaatgataaaaagctataaaacctacagaaaacaaatagcagagtgccaatagtaagttcttccctttaaatgtaaatagattaaactctgcagccaaaagatatagattggcagaatggatttttttaaaaaaatccacacaggatccaactctattctgtctataataaactcactttagccctaagtacaagcacaggttgatagtggaaatacggcaaaatatattctatgcaaatagtaataaaaagaaagaagggtgcctatactatcagccaaaatagactttaagtgaaaaactcttataagagacaaggaagggcattatatagtgataatagaatcagttcaccaagaagacataacagttttaaacatatatggaccaaacaccagagcttcaaaatatatgaaatattttcctaaatcagagtcatgggtattttctcctagattatcttgtaaagttttataattttacatttatgtctataatccatttttaattttttataaagagggagttataagtagaggtttatttttcacataagatgccaaattattccagcaccatttattaaaaagaaaattctatctgttctttgatctttatcaaagatcaattgaccatatatgtgggcatcagtttatggattctctattctgttacattgacctgcatgactatcttgattactgtaacttaacatcagatagtgtgattcctctaactttgtcattttcaaaattattttagaatttttgcccctttaccatgccctatacaatttaagaatcagtttgtgctttatcaggataagaaaattgcctttatttgtactttgctgagagttttcataatatgtggatattcaattttgtcaaatatttttatgtacctagttgtgtgactgttagattttatcaaagcattgtaagaaaattgctatgagtactgcagaggattagctcttcttgttattcccagatcagccctatattttgactggaatttttcatttcactaatatgtatctagaggactgtatattcttccctatttatttaagcaattatttatatacatttagaattaaaaataatttaatactttgagatataattcaatactactttgcttattttattgcacaaattgttctagttttggccactgggagttctttctgttggctcctgtattcctttgatatacccccatcattgagggtttttaaaatgtggtttattattaatgaaattaaaatgatctattcatagcacctgagatgatttcagatatcatattatgcaagcattaagataatattaagaattagtctggtaaatgaaaatcatagaatcagagtacttactcaatgtcaagttttgctaataattgcaatgacacaagcagttatatgacacaagtgaagcagaaagtgttctgggaccccaatgtgacttattgggtcatttcttctcacatgagatgtgttctggtacagatcttgcacagaagaagccacttaggtcatgaattactgagttacatagtttatgtgacattttccttggagccatcccctgtaaacctaaagattccaggtctgtttaccacaggtgattctagataggcagctatattttactatatgtatttcatagttctctcttgctagccaaggtcacatactttgtttgccaggagagctgccattataatgtttacaaggcaattagacaagataatatgctttctttcttcctttgatgcatcacccaaactctgccatgagagagaagggcatgcaggtctacttcataagtcctttctttctagatattctggtacagtattttaatgtattttatgatacagatactctagcatttaatatattttaatgtatcatgtttaatataagctcgataaagaatcatcacttcacatactttggataataattgtacacagtgcaaattcatggagaaaataatcagaaccattaatgctgataattttggggcatttaaacctttttcaggtcaatggattaatagatttattagctcttgcagaatgcaagcatattacagatttatagtataagtggttaaaaacatttttatttcactgaaaattcatgtaaagtgaagcctttgcaaaactgtaacctttatgcttttaataaaacagtatttctgttgtacatggtaatgattttgttctggaacactatgtataagcagattttgaattgaaggcagtggagcaagtctgtcaaaaatcaattcaattgatttccatttatgtagatgcattgagttttacagtggttgaagctctctttaaattgattggattcagaatgcaggccagtggtccgcatccatattctacaccttttttccaaaacttggtaaagaaaaatgctttagaaactttcctgaacaaataatataaagatcataccatctatatgttaaccaattagttatgaaatctaaaatcattaaggttacatttcaaaagtgaagttactaaaaaggtgaaattcaaatctaatagaaatagggtaaaatgcagaacatttatgaaacataaaagagggactatctgtgttagcaattaagggctgtagcaatttctgatatcagattccaaatttgaagagatccagacacttcatatacaggtttattttgccctaatattttgtcttattgagaattgtggtaaagagagaagacctgagtttcattcttataatggtttgagacatgaggaagtcactgaacatttctggacgtaactcacttgcatgatttcaactatcacatatacttggatgcttgaattacaaacctatgtagactagactttcctgctaagctgaaaagctgtatatgaacatttctttcatgttagctccagttgactgtttctcaggtactttcaatttcacatgtcccaaatttttctgattttcctctggcctctgaatgccctttctctgtgagcagcatcgtcacacaccttgtcacccaatctcaaaaatggaaagacaccttccaaatagcctcttctcaccacccttatcctattccacaccctgtttcaaacactgtgaaggtttttggggtagctgttcaaaggacctaccacaattagtttctgaaaagaacaaaaaaattactagctccagctggttgaccatcacaattgagatcatgcttgattctgcctctgatgtaagattttcattgctcaaggcagtcaataaattttgattcttaaagacacactctgataattttctgtgaagtaggaaactcactcaagaagaccagcctttgagtggtatcacagtctagactttaaatttataaggtggaaatgggctatagttggaatagattcttagctctgtggattctatttctatcacagctctcctatccacctccctctccattgcccatgaaatggcctaaatccaggcctttaacactttttatttgaattattatggaaatagttaactgtccttactgcctccagacatgcttccctctagcttcctccttcatattgatgtgcaatgatataaactccaaatctgatccaaatctgctgaaaagcctttaataaatgacttcctacattttttcaggaaaaagtttaagttttgtggctcatcacataccacattttttgaatgaatatacagtaaaataaaaagtagtagaaataccatttgacccagcaatcccattactgggtatatacccaaaggattataaatcatgctgctataaagacacacacacacacacacacgtatgtttattgcggcactattcacaatagcaaagacttggaaccaacccaatgtccaacaatgatagactggattaagaaaatgtggcacatatacaccatggaatactatgcagccataaaaaatgatgagttcatgtcctttgtagggacatggatgaagctggaaaccattgttctcagcaaactgttgcaaggacaaaaaaacaaacaccccatgttcttactcataggtgggaactgaacaatgaaaacacatggacacaggaaggggaccatcacacaccggggactgttgtggggttggggaatgggggagggatagcattaggagatatacctaatgctaaatgatgagttactgggtgcagcacaccaacatggcacatgtatacatatgtaacaaacctgcacgttgtgcacatgtaccctaaaacttaaagtataataataataaaagaaaaaaaagtagttgaatgaatatagagtaaacaaaaatgggtgggcctcatgcttctataaaatacaaggctttattaggtaaattaaaagtttcttaagcttccaacattttcttattccacaggaagctgtaaaattttctgcactggatccacactttgtctttatattctcctctcagcacaccatttcccaatatttggcaacccacaggttagcatcgaaaataaacaagtcagggtggctggcaaggtggccaaataggaacagctctggtctgcagctcccagtgagatcaacgcagaaggcagaaggtgggtgatttctgcatttccaactgaggtaaccagctcatctcattgggactggttagacagtgggtgcagcccaaggaaggtgagctgaagtagggtggggcatcacctcactcacgaagtgcaaggggttggggaactccctcccctagccaagggaagccatgagggactgtgccatgaggaatggtgcattacagcccacgtactatgcttttcccatggtcttcacaacctgcagaccaggagattctctcgggtgcctgcaccaccagggccctgggtttcaagcacaaaactgggtggccatttggacagacactgagctagctgcaggagttttttcataccccattggtgcctgagaatgccagcaaaacagaaccgttcactcccctggaaagggggctgaaaccagggagccaagtattctagctcagagtatcccaccccaacagagcccagcaagctaagatccactggcttgaaattttcactgccagcacagcagtctgaagttgatctgggatgcttgagcttggtggggggaaggctactcaagccatcactgaggtttgagtaggcggttttcccctcacagtgtaaacaaagctgccaggaagtttgaactgggtggagcccactgcagctcagcaaagccactgtagctagactgcctctctagattcctcttctctgggaagggcatctctgaaagaaaggcagcagccctagtcaggggcttatagataaaactcccatctccctgggacagagcacctgggggaaggggcagctgcaggcacagcttcagcagacttaaacgttcctatctgctggctctgaagagagcaatggatctcccagcacagcgctcaagctctgctaagggacacactgccttctcaagtgagtccctgacccctgcacatcctgactgggagacacctcccagcaggggtcgacagacacctcacacaggagagctctggttggcatctggtgggtgcccctctgggacaaagcttccagaggaaggaacaggcagcaatctttgctgtccggcagcctccgctggtgatacctgggcaaacagggtctggagtggacctccagcaaattccagcagattggatgttattggtttatagaaatgctactgaattttggacattgatattctatcctggaactttgttgaagttgtttatcagagctgggacccttttgtcagagactgggattttctaggtatagaatcatattatctgcaaacagagatagtttgacttcctcttttcctgtttggacaccttttatttccttctcttacctgattgctcttgctaggacttccagtactacaatggctaggagtgatgagagtgggtatccttgttttgttccagttctcaaggggaatgtttctggattttgcccattcagtatgatgctggctgtgagttgtcacggatggctcttattattttgagttatgtaccttcaatacttagtttgttgagggtttttaaacacgaaaagatgttgaatgttattgaaagacttttctatgatgatcatgtggtttttgtttttagttctgcttatgcaatgaatcacatttatggatttatgtatgttgaaccaaccttatatcctaggaataacgcctacttgatttggtagattagcttttcgatgtgctgctggatttttgttgaggatttttgcatctatgtttatcagggatattggcctgaagttttctttttccattgtttctctggcaggttttggtatcagaataatgctggcctcatagaatgagtgagggctcagctcaggctctttgttcactccccagcttgcaggcagcaggggcagggaccttggcagtgacaatgttagagggcgttacacttacctcttggagctccaacccagagaaatgcagagcctctgctaaccaaaatgatcagcccggggtggagtggctacatcacacacccaagttgtaggccttgcctggtggtgagcagggggtgggggctcacagggaagacagtctggcctctttgggaaagagcaaagaacctgagtgcctgtggtgtgctggaggtgtaataaggcactcaggttctttgttctttcccaacctggtggcagcaatagcaggcaccgctgtagcagtggtgtcagagggatcgtcagttgcctctgagaactccaccccagagatacatgaagctactgccaatgggaatgatcagctgggggtggggtggctgcatggcaggcccaatccaggggccctgcctggtgtagagcagggggtcaggggttcacagggaaaagagactgggttcctctctgtatggcagctgcagcatgctggaggtaccagcaaaacagtcaggatctttgttctttccccagcccgagggcagcaagtgcaatatccctgcagctgagatggtagacagcctttgggtcgtctctgggatttcctctccagataaacgcagtgccaccactgactgaagtgctcaggcgggggcaggatgactgtgctggggtccaggttgggaggccctgcacaatgaggagtagcaggggcaggaatccacatgggaaatagtctggctgcttttctgtatggcagctgcactgcgttggagacatacgatagtccttaggctcgtcacttactccctctgccgcctcagggcagtaggggtgggggctgcagcagcagcaaaaaggcagaactttcagttaactctgggagctctggcccagggaagtgcagagtcgctactagcctaagtattcaggcaggggtgtgttggctgcgctggggacctgggccggtgggctttggctggcaaggtgtggcgaaggtaaggcctatagtctgtctgctcctcagcactgtgaaagcagcatgtatcttgggagcatgcaagagggcttggcctcacctgctggcagagctatggcagctgaccctgggatgctcaggagcccaaggcccttgaggctccatatgtgcctgagtggcagctctgcccagactccgcacagcgctctgtcagtctggaggccctggagagagagggtcaggggatctcctgtgcccaggattgcagagatgcatggcaagagtatgggctcctgggggctcttgctcactcaccctttccctgtggtgagaagccttccttggctccatgccaatcccaggtgggcagctgtcctgtctcactcttctctcggggttttgttgcttccttgatgagtcccaacgtgtcctcctgggcaatccagttgaagaggtagtgtttattggccattctgtccctttatattatgcaacccatctgagccatagtccttcagccacatccatgaccaagtgcctgggagatttaaataaactcggtgctccgcttgtgtagtaaaaacagactaccacctaagctgagatttttaatcatcacttatggaaaggatatccatgaaagtccattaaaactatgaatatatacagattgaatatctgataagacacatcttgaaaatacgtaaatattttgatgcataatgtttaaggaaggagaaaagaacagagacctttttttaaccttttcgtcctatgtgatatctgtatttagaatacagttaactcatctgcaaatccgattctaaataacagagaaaaaaatctatgttaatttttccccatttcacttgtattatttggggatatgtaatttctaaaaggcaataggcaatacaatgatattttaatttttaaaaacaagcagttttttttttttttttttttttttttgcttttctcacttggaatgccaatcaacaagggttttttggttttttggttttttgcttgtttgtttactccacttataatgaaatcaagtagtttttctgaacagaataatatattcaggggaagaaatagcttataagattattgactgaatgtgaagctcaaacattaaatgagatgaaaaaactaaattagttattccctgagacaaacagggatgggagaatacctctgggaggcagctccttttcctcagttttacttatgtatttagttcaacatatccacacatagtgcttatcatataccaggtactattgtaaaatacgtaactgttgatttactggattctcataactccctgggaaggttattattatcattttgcccttttacctgaggcaagtgaggctcatacacggtgtgatggttgattttatgcatttacttgactgggcatggggtgcacagacatttgatcaaacattcttctgggtacttccatgagggtgttttctgatgagattaacattgcaatcagtagactagttaaagaaagcagattgtccttcttaatgtgagtggccctcatctaatcaccagaaagtctgttaagtagaacaaaaaggctgattcttgagcaaataagaaagaactgctcctgcctggcggtttcagcttggacattggtgtcttctgtcttcagactcagctgaaacattggctcctcagactcacactggaactacaccattggctctcccaagtctctagcttgtcagttgcacatcttgggacttctcagcctccataattacatgagccaattccttatcataaattttattatatatatgcatgtgtacacacacacacacatgcacacatatgcacacacgcacgcacacgtgcatgcacacacacacacgcactcacacatacacacacaatctgtttatccagaggactctaatacagggagtaagtgtctcaaggccacatagttacaaagctcacccagggagtctgactccagggcccatgctctgggcatcaaatatcactcaatgttcacataaaacataatgtcttaggcacattacatgtacagtaagtcataacttaatgtcattgataggttatttgaaattgcaactttaagtgaaaagacatactgtatgccataggaacttaactcttatatcaattagcatatggtaaaattggttttgttatatagtacaatattttacttaaagttgcagtttcttttttttttttttttttttgagacagagtctccctctgttgccccggctggagtgcagtggcgcgatctgggctcactgcaagctccgcctcctgggttcacaccattctcctgcctccgcctcctaagtagctgggaccacaggagcccgccaccaagcccagctaattttttttttttgttgtatttttttttttagtagagactgggtttcaccatgttagacaggatggtcttaatctcctgacctcgtgatccacccgccttggcctctcaaagtgctaggattacaggcatgagccaccatgcccagcctaaagttgcagtttctaagaacctgtcaatgccattaagtgaagacttactgtactcctgtgagatcaatactaatatctcaatttgagaaatgaaaaatttgagtctcagatgatttaagcaaaatacccaaggttacatagttctatgtagctgaggtagaacttgaacccagatctttgtggctccaaacaccattttctttccaatttgccttctgtcagttatctacctttaattaatataagtatttatctacctttaattaattactatacataatcatgaaataagctgaattatctctgcattttaagatctagataaaatgggtttattaccacactggtggaaaatcccagtagccctcctgcatttatgtgaatttcagattccctgactctgaattgacaagttctctaaactcttttttctctttgcagcatctagaaacttcttacttccacatgaggaatgcaatgtcatttgttggattttcacatgacaacaaaagaaaataataaacaagaccttgcttgcatggaaaattcattgcctattgtaggaaaagtcagggatgtcattacacagagcaaagaaaataacagaggttaatcaatgttactgctagcttgctcttatatatacttattttcatttctgatgcttttttcctctcaagggtaaaaaaacaaacatcaaacctctataaatctctcatgcagggcacccagctttctgcagctctgtccttctttggtttgtaatccacacttttgaagcccttctaagtgcattcatagacaaggccatctctccccttggcctctgactgtggggcagggggtaaaaagtgggaggtgggttatatgcttctagttgggtaaatgctaagcgtttttatgtgggttgcattttatttttgctttctaacaaacataattgaacattcagaaagggtaagtaactttccaaaagtttcacagatactgaaagataagtcagggttcatactttggtctgtctgatcacaagccagactaagatttgaacttctatgagactgtttcctcaaatttaaaatcagaatcatgttatctaattcactggctgaaccaagctcattcctcacccattttttattggtacttcttaaagaatgtggtcctcactctctagattccatgttttgagcgtaaaattcctatccctgtaccccaggcagagaggactggaccaggcgtggacctctgacctacaagatccaaggcattatgtttgcctggttcatcacctccttcaattgtagatgctgcagatgctgccctctctgtagaggtttaagtaaacaggaaagaatgtttaatgaaaataaggggaacaaagaaaccatgtggagtaaaagcagagatgacacatcaggaggccacaaatgaacaataagtgaaacattagttcctggacctcaaaccttcatgccagcattcaggaggcttcctaggcaaggaagtaaattggtgtgaggtgactgaactgcaagatgaggtggaatttcaacattcagactgccctctctgcagaggtttaagtaaacaggaaagaatgcttaatgaaaataaggggaacaaagaaactatgtggagtaaaagcagagatgacacatcaggaggccacaaatgaacaataagtgaaacattagttcctggacctcaaaccttcatgccagcattcaggaggcttcctaggcaaggcctgtcagctgtcctatttcttccactagatctctttcttttgttttgtttaagctagtttcaatgacaggcaactatctcttgtaatgaaatgatcctaagataaagggttattgtaaagttcaaatgtaattagataaggaaatgtgcgtacatgtggttagcacatatctagaaaatgatggttattaaagagtaactgtttggttacaattatctcaatcttagcactattaaaatttcccggaggtcagcctgcttttttcaggacaaggattataatattccacgagattcaaattagtcatatatttttaatttgaaaagaaaactacaaaagatgttataattcaatgtaagcacactttatagcaaatttattgtttgatttcattttcatgctatattaaaattttttgtatcagtgcttgtccaacatggtacaatggaaacaatcacattggaataatcaaatttttgaattacttataatatgctctttcattttaccagattttttgaaacaaaaaatgaatattgaagaatattcatagtatctatagctattttctgttcagtttctgaaagaatgaggaatagtagcttttcaaaagttggattttggtttttgtttaattataatatcattcaaaggactaataaagactaaaaggaacaatgactttattgtaaagatacatatagactgactcttcaaagtcaccatgaggaaggctgcactgtggctatttaaatgtaaatatatttaaatcaaacaaaactaaaaatatagttttttagttacatgagccacatttcaagcgctcaatatgttgctaccatattgcataggtatggaagatttccttcaccgcaggaagttctgtaaagcactagctttctccacatctttctttctttattaggcattgttttccataaaattttctacctgctatgaccactcaaagctctacttccatctcacccatgggcaaaatatgcgctacagtggccatttacctttttgttaaagtcacagaaagaatgtagtaacactcttattttttttaatccaacaacctcttttaattgtgaaactgctgcctctgactacaagcatgagcaattgaccaggtctaatctcatcaaccatggctccttatattccttactctagttgtgagtccaagggtaggcatggaatcgtattaggatcatagatcctctatgagattataatattccaatattggggcaagataggtctctcttgcttttacttggaacaagtgatcgatggagatggcagaggccatcttggcaccatagggaaaaggcctgcttgagaatgaagctaagcaaatgcaaacagtgctgagagatgtggcattgttcctaaatctcaacgtgtgaaaaaaccaattcctttagcttgaatgtggttacagctgtttgcaaacaaaatatttctgaggctgaggagggaggattgcttgagcccaggagtttgagatcagtctgggcaatgtagcaagaccctgtttccatgaaaaaaaaattacctgggcctggttgtgtgtgcctgtagtcccagctacttgggaggctggggtaggaggatctctcaagcccaggaagtcaaggctgcagtgagccatgatgacactgctgcactccagcctacgcaacagagtgagaccatttcaaaaaaaagtctggttaatatatgggtatttgtgcattttatggcattgtgtattaaaagatacatatttacaatactacattatttaactctctaagtagatttctatatagtataatactgccattatgttttgtctttgacattgcatattgtcaattttattcagtttatttagtgcatactttatgtaaggtactctcatattcgacaaaaattcttctaataaaataaatggacaaatcaagaatgtatcaaagaatatgagttctgtcttgatcattggtacagtttggatatttgtgccctccaaatctcatgttgaaatgtgatccccagtgttggaagtggggcctggtgggaggtgtttgcgtcataggggtgggttcctcatgaaaagcttggtgtcctccctgtggtaatgagtgggctcaggttctattagtttacaggaggtctgattggtaaaaagagtctggcacttcgttccctctctcgccatgtgagaggccaactcccccttcaccatctgccatgattgtaagcttcctgaggcctcaccagaagcagatgctgatgccatgctttttgtacagtctgcagaactgtgagccaaaataaatctcttttccctataaaccactcagcctcagccgaccgcggtggctcacgcctgtaatcccagcacttcaggaggccaagatgggtggatcacgaggtcaggagatcgagaccatcctggctaacatggtgaaaccccgtctctactaaaaatacaaaaaaaaattagcctatcgtggtggcgggcgcctgtactcccagctactcgggaggctgaggcaggagaatggcgtgaacccgggaggcggagcttgaagtgagccgagatcgcgccactgcactccagcctgggcgacagagcgagactccgtctcaaaaaaaaaaaaaaaaaaatcactcagcctcaggtattcctttatagcaacgcaaaatttactaatacaatcacaattactttttaaatgcaaactagctgggaaagttgtctgtctcaaatatttaagactataattttatgatcatacaactcatactcccagcactcagtaaagacaacttatatttctgtcagtctttcatatgcacaattagaaaatgattaaaatagtctgataatagatttccctgttaagttcagaagcccagtattctttcttggtttttaactggcatgctacttttaattttatatttatttctgttaatgatgaatatagaggcaataaatactacttttctttatataggattggattacaattaactgatgaatttaggaaaggacttaaagatttatttttatcatcttgtaatttaaaacaaaacaacagggctataaactccaactatgcaagtaaatgtaaagctcaacttcaaaaaataaatgacttgacaatgatgaaaaagtagaaaatgtttgagaaactttatagaaatatccttttacttcaaaaacaggagaaatgtgtactacaggtaggcccctacttacagactcctaattattcatatgtgaattctcagaaggcaagggctgggggtaatactgcttttaatgaaaatctgcttttatgagttttcagatgccataaccaaactgacattgtgtaccgttgttctctggggagcttcatgcgcagaatgaactcatatgttacatgaccttgggtcaaacaatatcttaaagaagtaatcagtataacatttcagaaattgaggtggccaaagtcggtccaggaaagtctctcaggatttgatatgctgagtgcaggagaattcattttccattcagagaaaaggtcgtacaaagtattcatgtgcctcaagtgctgaaagcaatatagaagaagaaaaattgggcttaaacaaaattttaaaaaatctgtcttcattttctcccccatgatcctttatatctaggaaggctattactgtggagaggacttaatatggactatttagaccagtcatttgaataaacgtcctaacaacagcagaaaaacatgatcagtgttctgcagaatctggacttgtaatcaagtagtcagtgtttaagagacaagtttaggtcatggaaatatactggagccaaaaatcagaattctagtttttgctccagcactgatttgttcagctatgagtgatgttttcagatagatttctttagggtaggaagcaataatgttatatgacttggaaaggcttgatgaatgttactgagtaaatagatgtttgctgattgctgttgaacagtggatcaaattattaaagaaaagttaggatagaaaaatccaaatacaggcggggtgcggtggctcacgcctataatctcagcactttgggaggccgaggcgggcggatcacgaggtcaggagatctagaccatcctggctaacacggtgaaaccccgtctctactaaaaatacaaaaaattagccgggcgtggtggcaggcacctgtagtcccagctactcgggaggctgaggcaggagaatggcgtgaacccaggaggcggagcttgcagtgagctgagattgcgccactgcactccagcctgggagactgagcaagactcggtttccaaaaaaaaaaaaaaaaaaagaaagaaagaaaagaaaaatctaaatacaaaattataacagtatgtagccatttagagtccattagttacaaagctgttaagattatagatactgcatattataatatatacctgtggaatttctggaactgatattgtttttgtttaggcagttgccagtttggcaacattttacattttctgtagtgagtgaaaacaaattatttgatctgtaattactattttatgaaacatattatttgactgttaaatcatcaattcttttggagctggccaacaatgtaccaatttatttttagtagtgcagcccatgataaagaaaagcagaaagccactaaggacaaaaagattactgagagctcctcctcattgtacttaaattttgtttaggatgagataaatggaaaaagagcttcagactttgaagatctagaaatttgggcaaattttccaaatgttcgtgtggatgagtaaactgtcacatttccagaacgaagaacattgttttttattctgcatggagtagtattagggaaaatgttcaattgaaaaagttaccatataagaattatatccagagtatcatatttaattgattttttgcttacgcaaaaaaaaaaattcaattatcaatgtttttgagcaaaaataaggcaacaggtcaggctctaaaaataaatataagactataaaagatgcatgtcttatattctaccatggtaaatggggcagtggtaaaggagaatgcagagtcctccttctggtatacagaatttatattattgctttattattgcctcacacacatcaacccttgaggcagaaaagatgtgttcatagaaagcaacttaccagtgaccgtgccagacatgttcaaatatgcttcactatttgaagcatggtaagaatacactaatattatctacactaataactaataacatggtaagaatacactaataacatcgacaggaattcagtaaagatagaaatctgacaatagtaacaaccatcattaattaatgagtccttgttatataccaggcactgtgttagtgctctctgtctttctgtctgtctctctctctcagaaactatgcatattcatatatatttatataaaatgatcatacaattccagcagccacataaaagtttggaagcgtttccccttttttctctttttgaagaaatggggaaacacaggcacagacaaatatggaaactttgcagcattcatgcagaggatgcagaatggagcctgaattaaaatgctccctcggatagaagaggctttctttctagaaagactgtgtggtgaaggtcctggattgtgacaaatatgctatttcctctaaacccagactccctcctcttcaggtggtttgaaccatctttcctacccctaaacctgtagattatgcctccatctctcccatccttacactccactcaaaaggtaagctgctctcttcgttctttctcttagtccattctgcctccaaatgtctccaccatactctctctggaacaccattccattctcatcaactccctccacatcctctaccttacacaccttgacttaagtgagccttctataaagacactgcccacctcccacctccagcaattgcaaagggatgcttctcagagttggaggcttcttggggttgggaggagaggccagtgttctccaccctcagtgcagttccagaccattcctcctatgaaacaaaccctttcccttgaggctgacaacatccagccatgtgaccctgtacttctttctcacactcttttgcttttactgaagactttgaagctttttctctaagtttcaccatcatttttgtatctggcacatagtagttgctaaattatattattaaaaaattcacagtgattattcttaataaattatgtgtgatacactcacaattcatggtgaaatgaccatgtatctcgagaagagagttgaaaaggacaatgaggacaccccttcccatactccaaactctaagttgcatgatcttgtcagtctcaggattgtcagccatccactcccacagccaaatcctagacatgctggagcttcgaaatattcgattataatatcacatacatacacacttattccaaactgcattcctccagccatcactcatcacctccactctgcctttcttcattgtattgtaaagaatgaattgggttagtgtgacagtctttatcagtattcccattactctactactttgtcttcctactgtacctcctgtggaaaaaaattccacatcatcatccaccagaccgtcttctgttctcctcctacacaaacaactctcctacagatgaagaaactcatataactgcattaaaagttcatttgaaaggcatagttgccaaactcagttggaataccacctggtatttctatattttcctgggcaactttctctttcacttcccacagagcatatttcaaacttctattgtgctttagttttctttattacatcaccatatgaaagtgtaattcatttattctgcacttacttactagacatctgttatgtgtcaggcaaagggtgctgggtattatggtagaaaaaagtataacatttgagtttgttccctctcacttctgcctttgttcctaaaagtattcacctatctctgtgcccaccttgcctaggggaagatatatctccctccatgcccaaccattctacctgtactctgttagctcagccattacctcagttagcttatccctctctcctctacctgaaaattctccatcctactggctcactgccccagcagcacttacacttatttatttctgtcctatctttaaccaatcaatatgaccactctcaaccattatgtttgcttctaagtatttccctatatcttctacattcttcagacccgcggtacagttgaccacgctcccctcctcgttcatttcattctctctccagcctcctgcagtttggcatcttcactattctaccgcagcagtcccttccagggtcaacaaagcctctttattagaaaatgcacagggcatttactttcttcagtctttgaactctgcaggcattttgtgtgtgtgtgtgtgtgggtggagacagaattttgctcttgctgcccaaggctggagtgtcatggcacaatctctgctcactgcaacctccacctcccgggttcaagtgattctcctgcctcaccctcccaagtagctgggattacaggtgcctgccataatgcctggctaatttttgcattattagcagagacagggtttcaccatgttggccaggctggtctagaacccctgacttcagatgatctactcgcctcagcctcccaacgtgctgggattacaggagtaagccactgtgcctggccaggcatttctttttataaacggtgtaccctgcctctgggccaccagaggttcctggtcttcttccactcacctctatgttcggttactctgcctgtcatgacatgcggtgatcctctatgttcattcttctctccttacagtttgtgtgttccatgaatgacattatttactccctcaaatccaagtgcatattttatttgtgtgaatccccaataagtaagttcctatggacagaggctgtgcatgttcgttgttttagtcctgacacctatcacagctgcctgacaacccagtgcccagcaacacagaaaaatgcacagactgaataatacaggaaattgtaggctgggcgcggtggctcaggcctataatcccagccctttgggaggccgaggtgggtggatcacgaggtcaggagatcgagaccacgatgaaaccacgtctctactaaaaatgcaaaaaaattagccgggcgcggtggcgggcgcctatagtcccagctacttgggaggctgaggcaggagaatggcgtgaacccgggaggcggagcttgctgtgagccaagatcgtgccactgcactccagcctgggcgacagagcgagactgtgtctcaaaaaaaaaaaaaaaaatacaggaagttgtaaccaggaggacccactgaaagtggagtgtattctttcactcagtattcactgggaatgcactatacactagttccaatgcttgtgttgggaattcagtgaagagcaagaaagacaaagtagcccctggcacttacattctagtaagggaaatagtcattaaacatatgtactatacagggagtcagagagtgacaagtgccacgaagaaaataaagcagggaagggagttacagagtgatagaaggtaaaagtgcgccagctagttagggtagtctgggaaggaaggctttttggtggcattaaccctgaagaaatgaatgtaatgagaaaatgcctagcggctatttgaaagaaaaccatttcaaaaggaggaaatggtaagtacggtgaagtgggaaaggctttggggtacttgaggagcagaaatcaggccaaagggattggagctgaagttctgattctaggtagaatataggaggcagtggcactgcatcactcccactgcaacaagtagttcaaaaagtaaagaaattggaaatgtaatcgttttaaagatatccgagagctgtggtggcatagatgattagatggactacaagtgaagttgagatgactcctatttccttcactgagaggcaaggtttctgttcagacttgccctaagctgaggtgtttcgccaggggaaagagaagacaatagagcttactttctacgtagcttcattgaggtatgactcatgcaccgtacaattcacccatataaaatttacaattcaatattttttagtgttttagagatatgtgcaaccatccccacagtcaacatttgaacatttttatcacctcagaaataaaagccatggccgggcgcagtggctcacgcctgtaatcccagcactttgggaggccaaggcggacagatcacgaggtcaggagtttgagatcagcctggccaatatggtgaaaccccgtctctactaaaaatacaaaaattatccaggcattgtggcacacacctgtagtcccagctacttgggaggctgaggtaggagaattgcttgaaccctgcactccagcctgggtgacagggcaagactccatcttaagaaaaaaaaagaaagaaaaaaaaggcacatgcttcagctattactccttgtcttcctaagcagcaactaggcttctttctcccagtagattgtcctattgtggacatttcatatgagtggagtcaataatatgtggtcttttgttactgacttctttcagttaacataatgttttcagggttctccatgttgtggcatgtatcagctcctcattccttttttgtgagtaaacaaaaaataacaaaatttaacattttaaccattttcaagtgtacagtacagtactgttaactgtatgcaagttgttgtgcaataggcctctgtaactttttcatcttgccaaagggaaactctgtacccgtggaaaaactccccatttccccctcttccctagctctggttgtcacattctactttctgtttctatgaatttgattactttagaaaacgtatacacagggaatcatgcagcattattccttttatgactggcatatttcatgtagcataatgtgctcaagccttatccgtgttgtagcatacggtaagattttcttctttctttaggctgaataatattccagtgaatatatggtttatacattaatgatttgtcaggagatattagtgttcttccaactcttggctattgtgagtaatactgcaataaagatggatgtgcaaatatcttttcaaaatcctactttaaatttttttgatatatacccagaagtgggattgctggactatatggtagttctgttttaaattttttgaagaacctctgttttccatagtggctacaccattttacgttgccaccaacagtgcacaggggtttcaagttctctatatccttgccagtatttcttattttctgtttctgttttgtctttttggatagtgatctagctaagagatgtgaggtgacatctcattgtggttttgatttgcatttctctgattagtgatattgaacatatttttatatgttggccatattgatgtcatccttaaagaaacgtctattcaaatactttgttaatagggttttttgtttgtttgtttgtttgtctagttttgatgttgttgagttgtaggaattctctatatgtttggatattaaccctcatcggatacatggtttacaaatattttcttctgttctgtacgttgccttttcactctcttcattatttcctttctgtgaagaagatctgaagtttgatttagttccatttgtatatttttgcttttatttcctctgcctttggtgtcatgtccaagaaatcattgccaaatccaaaaacatgaagcttctcccctatatttttatcttactaggtaattttataattttataaattttagttttataaatataattttataaattacagttctataattttaggtcttacatttaggtcattaatccattttggtttgtttgttgttttgagacagggtctctctctgacaaccaggctggagtgcagtggcatcatcacagctgactgcagcctcaaccttctgggctcaagcaatcctcctgccttacccccacctctcccagtaggtggcactacagggtgcgcgccaccacacccgggggaatttttacattttttgtatagacgggttcgcagtgttgcccaggacttgagcgatcctcccacctcagcctcccaaagtggtgggattacaggcgtgagccactgcacctagccgttaattcattctgaagtgatttttgtatataggtacaggaaggtaagggtctaacttcattattttacatgtgaatatcaagttttctaagcaccatttgttgaagacactatcttttccccattgtatagtcttgatgcccttatggcagattattttaccatatatgtgagagtttatttctgggctctctattctggcccattggtctatatgtgtgtctttattccagtattatgctattttgattactgtagctttacactgttttttgaacttgagaagtatgagacctccagctttgtatttctttctcataactgtcttgactatttggaatactttgagattcctaatggattttggattttttttctgtttctgcaaaaatttccaatgagatttttatacggactgcattgaatctgtagatttggggggtagtatgaacactgtaaccatattcttttccaatccaggaacatgggatgtctttatatttattcgtgtcttcattaattactttcagcaatattaagagtattcagtatacaggtcttttgcctctttggttgagtttattcctaagtattttattctttttgatgctcttgtaaaggggatttaaaaacattttcttttctgattatttattcttagtgtctagaaatgaacctgatttttgtgggttgattttgtttcctgcaactttactgaattagtttattagttgtaacagttgtctctgtgtgtgtgtgtgtgtgtgtgtgtgtgtgtgtgtaatccttcaggttttctacatgtaagattatatcatctgcaaacagagataattttatttcttcctttcaaaattgaatgctttttactcctttttcttgtctaattgctctggctagaactttcagtactgtgttgaatagacatggcaagactgggcatgcttgccttgtttctatttgtagagggaaagcttgagtatgatggtagctatgggcattacctatagggcttttaatatgttgatgtaattttcttttatttctatattattgaattttacatgaaagggtgctgaattttattaaaagcttattattgcactaattgagatgatcatgtgacttttttacctttctgtcagttaatatagtgtattgcattgactaatttttgtatgttgaaccatccttgcatcccaggaataaataccacttggtcatagtgtactgctgaattaagtttatgatattttgttgagaatttttgcatcaacattaagcaagattattggtgtgcagtctttttgtggtgtccttctttagcattggtattaaggtaatactggcctcataaaatgagtttgaaagtattttttcttctgaaatttttcagaggagtttgagaaagagtgatgctaactactctttaaatgtttggtaaaactcatcagtgaaaccgtctagtcctggggcttttcttcattgggagatttttgattactaattcaatctcctaagttatagatgtgttcagattttaatttattcacaattcaatcttggtaggtagtatatttctaagaatttatttcttctaagttatccaatgtactggagtattgttcatagtagtctctcgtaatctttttacttctgcgtcctcatttttaatgtctcatttctgatttgtgttactttagacttctattttcttacttattgaaagaatttgttaatttttttatttttttaaaaaactcttatttcattgatttttctatttttttaatttattctctatttcatttatgttttctgtaatctatgaccttccttttgctaactgtaatctaggaccttccttttactaactttggatttagtttgctattctttttctagttctttgagatacaaaattatctccaattattgattggggttcttcttttaaaaatacaaacatttactgccacagttttggtgtgttgtgttttcattttcacctgctttaaaatactgttaaatagtgatttcttgactcatcaagttgttcaagagtatattgcttaatttccacatctttgtgaattttctagttcagagttttctagtccagatttctagtttcatgattattagaaaatatagttggttttctttcagtttttttttgaattgttaaaacttgttttgtgtcctaatatgtgttctgtcttggagactgttttatgtgcacctgagaagaatgtgtatattaacatagggtggaatattgtttatatatctattagagtcaattcacttttagtattgttcaagttctttatttccttattatttttctttctggttgatctatttattattgaaaaagagtattgtaatctcctcctattattttttttaatctaattcttcctccagttctatcaatgtttgcttcatgtatttgggtgctctgctgtttggtgcatatagacttataagtgttgtactgtgaattgacactttcatcaatatgatgtgtcttgtttttctcttgtgacagtttttagcttaatgtctattttgtctgatatatgtatgggcacccttgctattttggttacctcttgcatggaatatatttttctattccttcattttcagcctgtgtgtgttttcaaagctaagtgaatctcttgtagatagcatgcaattggatctttttaaaattgattccgccactcggtcttttgactgcggagtttaatccattcacacttaaagtaattattgatggggaaggacttactattgcaattttgttaattgttttcagtatgtcttagagttgtttgtccctcttttcctctcttgctgcctttgtgtttcattgatttttttgtagtgttatgctttgaggacttccttattttctttggtatgtcttctatagcaattttctctgtaagttaccatggggattatataaaacatcttatagctataacaatttatttaaactaaaaatttaattcaattgcatacaaaacctctactcttttacctccaattcaccttacattatcaatgtcacaaattatacttttagtattttgtatccattaatataatttaataattatggttatttttatgcttttatttatacctgatttaaaaatgatttatggaccactattgtagtatgacaagattctgcattttttttttttttttagacagagtctcactctgtcacccaggctggagtgcagtggtgcaatttcagctcgctgccagttttgcctcctgggttcatgccattctcctgcctcagcctcctgagtagctgggactacaggcacccgccaccatgccctgctacttttattttattttattttttatatttttagtagagacagggtttcaccgtgttggccaggatggtcccgacctcctgacctcatgatccgcccacctcagcctcccaaagttctgagattacatgcttgagccactgcacatggcctagattctgcatttgactatatgtttacctttaccagagagccttatacttttgtatgctttcaagttggtatctagctttcttttatttcaactgaaaggactaccgttagaaattctagcaaggtaggttaatggtgatgaacttcttcagcttttgtttatctgggaagatctttatttctccttcatttttgaagggcagatttgctgtctattcttagttggcagttttctttctctttcagccctttgaatatactaccccattccctttcagtctggaatgttcctgctgatgagtttgctgataatcttatgagagttctcttgtatataagtcacctttctcttgctgctttcaagattgtctgtcttggacttttgactgattataatgtgtcatggtgttggatctttaggttcatcttagacagagtccttcaagctgctgaaatttggttgtccatttcatttttcagatttgggaagttttcagccatttcttcaaataagctctctgccacaggctactcttcgttgtgcaatctgtggacccagttgtcatctgccaccactgtctagttatcttttgactgccacaagtggactccaaaaaatctccaaaagaaattgttaccataacaagatggccaactagacacagccaggaagcactgctcccactgagagacaccaaaatattgagtacaccaacgtattttgagcccatcttcagagagaaaatgctgagagtcattacagaggtgatgcagacaacaaggctgaagagggaggaagctggaaaccctgcacaggatacttgcatgacagggctagttcccagacctggatgcctcctggggaagggataagtgaagggatggagggacaggccactctcactgtggacctctgggatcctaggtacatagaacttcacattctccatggacatttgagctggcagggggatcttcaaagagagttggcagagacagggcttcaccggcatggagcctaggagcttttgtgcatgtggagctgtggcagagcatggcctagacacccatcccccagggctccccacctccctacaggcagctctagcctcagctgattgctggcccaggagagagtgtggctggcttccctgtgggactgggaaacttccagggcccctgcctggccaccctgcaggaggtgtgcacagagtagcctctgctgccaagcctgggtgctttgcttcacctgagtaccttcctggtggcctgggagcactttggatcccccagaacagctggggcccaatctcaagggtctggaggatgaagctgaaagccagtcctagctccccaaaactacacaaatacatggaaattgaacagcttgctccagaataactcctcggtgaacaataaaattaaggaagaaataaaaaaattctttgaaataaatgaaaatagggacacagcttaccaaaatctctggaacacagctagaacagtattaagaggaaagtttatagcactaagcaccttcagcaagaaattagaaaggtctcaaattaacaatgtacctttgcaactagaggaactagaaaaaaacaagccaaccccaaagcaagcagaagataataaatatctaaaattagagaagaactgaatgaaatttagacacaaaaatccatagaaaagatcaatgaaacaaagtgttttttcttcaaaagaataaacaagatcaataaaccactagctatattaacaaagaaaaaaagagaagatctaaataagtacaatcagaaatgacaaagaagacattgcaactgatcccacaaaaatacaaaagatcctcagagactattatgaacagctctatgtacacaaattaagaaaacctagagaaaatggataaattcccggaaacacacaaattcccaatattgaaccagaaagaaaatgaaaacttgaacagaccaataagttccaaaattatatcagcattaaagaaactgccaaccccaaaagaaaaaaaagaaaaagaaaaagaaaagccctggaccagatggattcacagacaaattctctcagacataaaaagaagaactggtaccaatcatattgaaactattcaaaaaaatcgaaaaggaagggcacctctctaacttatcctatgaaaccagaatcagtctgataccaaaatctggcagagacacaacaaaaaaagaaaacttcaggccaatatacctaacgaacataggtgcgaaaattctcaacaaaatactagcaaactgaatcccgcagcacatcaaaaagttaatttaccacaataaggcaggctttactcctgggattcaaggctgattgaacatatgcaaatcaataaatgtgatccaccacagtaacagaattaaaagcaaaacccatatgatcatctcagtagatgcaaaaaaagctttcaataaaatccaacatcccttcatgataaaagccctcaacaaactaggcatctaaggtacatacctcaaaataataagagccatctacaccaaacccacagccaacagcatactgactgggcaaaagccagaagcattccccctaagaacaaaaacaagacaatgatgcctactctcactgctgctattcaatgtagtactaacagtcctagccagagcaattaggcaagaggaagaaataaaagacatccgcggctgggtgtggtggctcacgcctgtaatcccagcactttgggagaccgaggcgggcagatcacgaggtcaggagatcgagaccatcctggctaacacagtgaaaccctgtctctactaaaaatacaaaaacaaaaacaaacaaacaaacaaaaaagacatccgcatgggaaaagaagaggtcaaattatctctcttcactgacagtgtgattctctctttttttgaaactgagtctccctctgttgcccaggctggagtgcagtagcaccatctcagctcactgcagcctctgcctcctgggttcaagtgattcacctgcctcagcctccagagtagctaggattacaggtattcaccaccacgcccggctaatttttgtattttttagtagagatggggtttcaccctgttggccaggctggtcttgaactcctgacctcaagtgatctgcctgcctcagcctcccaaagtgctgagattacaggtgtaagccaccatgcttggccactgataatatgattctatatctagaaaaccctaaagactctgccaaaaggcccgtcaaactgctaaatgacttcagtaatgtttcagggtacaaaaataatgtacaaaaatcaatagcatttctatatataactgagtacctcagcctcgaaatacatttttaaactatttttttcctttccttcctaatctcagaatgtagccttatagtgtaagactctttgttatgccctttccctacaggcatatctgtgtacagtgcttgctcatctaactatgtgcttgcttagaaattccaggagccaattttgaaacaaaccaggcagagagaccaagccacagatcttcccactcaaggggagttacgcccaagtcaggatgatgcaaatcagatctctagatgggagattacttgagataactatgggaacaagacatgcagatatgcactcccttttcactactcatgtctatatcccacacctttttccttcttaaaccccttcactcagcccagaaggctgagatggctcttttgaggcttatgcccagacattgtcccatctgctagcatttgaccaataaaagttgctttcctttcaccacacctcagttctcatgctttgacttctgagaggagagcagctggacttgagctggttacatatacaccaataatgttcaagctgagagccaaatcaagaacacaatcccatttacaatagccacacacaaaaatgaaatacctaggaatacagctaaccaagaaggttaaagatctctacaaacctgacaatgttggtgttgtcgtgtttggaaatgattaactgattaaggaaggagctagaatgaagaggacaagagccattgtggacattccagttggtgaggagctgttgggtcatgtggttgatgcccttggtaatgccattgatggaaagggtccatttggttccaagaaccataggtgagttagtctgaaagcccctggaatcattcctcaaatttcagtgcaggaaccaatgcagactggcattaaggctgtaaatagcttggtgccaattggccatggtcagtgtgagctgattattggtaatggacagactgggaaaatctcaattgctattgacacaatcattaaccagaaatgtttcaatgatggatctgatgaaaagaagaagctgtactgtgtctatgttgttattggtcaaaagagatccactgttgcccagttggtgaagagacttacgatgcagatgccatgaattacaccatcgtggtgtcagctacggcctcagatgctgccccacttcagtaactggctccttacactggctgttccatgggagagtattttagagacaatggcaaacatgttttgaccatctatgacaacttatccaaacaggctgttgcttaccaatcagatgtttctgttgctctgccaaccccctggttgtgaggcctatcctggtgttgtgttctacctatgctcccagttgctggagagagcagcccagatgaacaatgcttttggtggtggctccttgactgctttgccagtcatagaaacagactggtgatgtgtctgcttacattccaatgaatgtcatttctatcactaagggacagatcttcttggaaacagaattgttctacaaaggtatccaccctgccattaatgtcggtctgtctgtgtctcgtgtcagatctgctgcccaaaccagggctatgaagcaggtggcaggtaccatgaagctggaagtggctcagtatcatgaggtcaccacttttgcccagttcagttctgacctcgatgctgccactcaacaacttttgagttgtggtgtgtgtctaactgagttgctgaagcaaagacagtatactcccatggctattgaagaacaagtggctgttatccatgtgggtattaggggctatcttgataaacgggagcccagcaagattacaaagtttgagaatgctttcttgtctcatgtcagctggcaccaagccctgttgggcactaccagggctgatggaaagatctcagaagaatcagatgctgaatttgaaccttaaacgcctgtggatttacatcaaataccagttcagttttgtcattgtttattctagtagattagtttcatttgtgaaagggttactctcatactccttatgtacagaaatcacatgaaaagtaaaggttccataatgtgaaaaagaaaaaaagatatctacaaggagaactgccaaccactgctggaagaaatcacagatgacacaaataaataaaaaaaaattccatgctgatggattggaagaatcaatattgttaaaatgaccatgctgcccaaagcagtttaaagatttaatgctataactaccaatgtcatttttcacagaactagaaaaaactattctaaaattcatatagaaccaaaaaacagcccgaatagctaaagcaatcctaagcaaaaagaacaaagctggaggcatcacactacccaacttcaaactatactataaggctacagtaagcaaaacagcttggtcctggtacaaaaaaagacagatgaatggaacagaatagataatccagaagcagttctgcacacctatagccatctgctctttgacaaagcccacaaaaaaatgggaaaagggtcccctattcaataaatagtgctgaaataactagctagccatatgcagaacaatgaaactggacccctaccttttatcgtatacaaaaattaactcaaaatgaattcaagatttaaatgtatgacctcaaactataagaatcctggaagaaaacctaggaaaaacagtattctggacatcagccttggcaaagaatttttggctaagtccccaaaagcaattgcaacaaaaccaaaaactgacatgtgggacccaattagactaaaaagctcctgctcatcgaaagaaactgtcagtaaacagacaacctacataataggagaaaatatttgcaaagtatgcatctaacaaaggtctaatatccagaacctatgaggagctcaaacaaatcaagaaaaaacaaacaaataaccccattaaaaaatgggcaaaggacatggacagatacttctcaaaagaaggcatacaagcggccaacaaacatatgaaaaaatgtccaacatcactatcatcagagcaatgcaaatcaaaaccacaataagataccatctcaccccagtcagaatggctattatgaaaaggtcaaaaaacaacagatgctggtgaggctgtgtgtgcataaaagggaatgcttataaactgttgaggggaatgtaaactggttcagccactgtggaaagcaattgaagatttctcaaagaacttagaactaccatttaacctaccaatcccattattgggcatatacccaagggaaaataaatcattctaccaaaaagacacatacacttgtatgttcataacagcattattcgcaatagcaaagacatggaattaacctgggtgcttatcaacggtagattgaattttaaaaatgtagtagtagtacatatacaccacagaatactacacagctatagaaaataatgaaatcatgtccttttcagaaacatggatgcaactggaggccataaccctaagtaaattgttataatataggaatggaaaaccaaatacagcttgttctcacttgtaagtgggagccaaacactgagtacacattgacataaatatggtaacactaggcactgtgaactactggaaggggcaggagggaggagagatgggttgaaaaactgcctgttaggtaatatgctcactacctgggtgatggaatccatatcctaaacatcagcattattccacatacctgtgtaaaaacttgcagctatgtcccctgaatataaaataaaatcaaaattatttttttaaaaagaaattgttgtcattacaggaagtggtagatattttgggttctgcctaggctgtttctgaatcagaagggagtccatatgattctgtttgacataagtatccctgctcaaacctttctggaaggaatcaagtttatacatggagacatctgtcatctctctgaggtagagaaagccttccaggatataaatgttacctgtgtgttccatattgtcttttatgttatgtcagggtggaaacaattgaatcaaaaactgcttgaagaagtcaatgtgggggacacaggcaatgtcctccaggcttgcaggaggataggagtaataaaattagtttacactagtgcttttaatgcatatttggaggtgaaatggtcagaaatgaagatgaatctgtctttcttagctcttcacctctaaagcaatcactactctcagacaaaattgactatggacaaaaagatagtggaagtaaatggtgtttttcctcccctacatccctaacatcctgaatcccttcccttaagtctgtgaccactgggatacttggtcccactaagatagctttcctccactatgattcctcatctacatgttcagtgtcatcagaagaatgatgtccttttccagatagctgaattacacagcatttaaatttatcttatttcattttttatgagaagttataatattggaataaaaagcagaaacaaggaaagagattttctgaagtatacattttatatgagccaaggaattagtacctggaaaaataaactgtgatgtttaaaattagtttatatatggagataattatgtttcttgctaaaatgcctatcaccctactgattctcaatttgaaataagcattataacttttacatgtatgaatatgaaattttacaaatttgacaggagaggccagagaattagcttgctctttttccaccatgtaggaataaaataagaaatcagcagtctccaatcagcagttactggaactcaaccatgctgatgccttgatcttggacttcccagccaccagaactatgagaaataaatatttcttgtttaagccacgcagtttatgataatttgttatatcagcctaaactgattaagacaaaaatgctaagaaacagaaggaccacatagtaaaattccataaactgttctggaattttatatctactactaaggtctagaatccagtaggtcctcatggattgaatatggcaccagcaagggggatgtggacatgagccagatcctaacacaaaggatatttgccctcagacctcctttatggttccttccaggagtgtgcagcccagaataaaggtttgatggagtgactggtgccacaggtatgagcaatcggctcataatgggggcaacagtttggaatcagagaatcatgattattcttgtaaatgatacttatggaccaaagaggcacattgggctcagaacatagcattttttcccctaggtctgtcagcctatatatcttttacaggccaggtatgtcaagagtctacatttgggagaggtcataaaatccatataatatacattttgtacacaatttcagaatttgtaacagattatactcaagatactgcattttatctagtgtgtttttacattataatttcacagggtaacagcttctcattttcaatgctaggttacttttatgtgatattcacattttgtaccaatctggtgttcagattttatattgcttgatatgattttttaagtgcataatcactttcttaaagtttctgtttaaaaacttatgggaagcatgacataatataaattatattagagatggaatacttaatatcccctaaaataccagataacttagaccagtatcccagtatttaaatatatagttgataactcaaagtaatttatcactgtttctctgtaatcattttgatgtcacaggttgtttaaggcttaatgatgattaagaacatttagtgaatttatgaacactttaatgaattgatttaacatttcagctgtttatgtgcaaggacccataaaattatcaatttaaatgacttgagaattaaaatataatagtttattcttggagcatcactttttctctctccagttattggtcaggctatcaaatgcttttttaaaaatctaagttttaaatatttttatttatttatttattttgagatggagtttcactcttgtcgcccaggctggagtgcaaaggcatggtctcagctcactgcaacctgcacctcccgggttcaaatgattctcctgtgtcagcctcctgagtagctgggattacaggtacccgccaccatgacccactaattattgtatttttagtaggggaagggtttcaccatgttggccaggccggtctcaaactcctgacctcaggtgatccgccccgattggcctcccaaagtgctgagattacaggtgtgaaccaccatgctggcctagatatttttacatgagattgtggatgataatctcattttgggtagatttgtattctgggtagatttttatcagggatcctgatttaaaaagaaaaaaaataaattttttttctggttatgattagcatttttcattaattaccacctattttagttaaagtagctctatttaattcatacaacattttatttgttagtgcatggtgcaattaaaacaatagttacaatgtcatgaaggacctgcgccaagaatcacatgacaccacatagccatcagtacctatgacaatgctacttttaaattctcattttttaatgagaatattgaggctccaagatgttaagtaactttcccaagaatacacagctagtagattcagatttataaggccacaaagcctgggttctcagttactactctgctcactggaacttgtgggagcaaattctgatcaacttataagctcttcttccccaaaagatcttatcttggagaagaaggagacctctatactgcagagctaaagttttgagtaggtcgtgcttgacttctggggcatgaaaactggttttatgaaggtaaaatcatcagcatttccatggagcatcttgtgtttctcagggcatgggaaccaaccatctgcagtataaagtaaatttttaactcataagtcaatggaattgttgttggtatggatatcaccatattatttggcaggtgattcttattttttttttttttttttttttttttgagacggagtctcactctttcgcccaagctggactgcagtggcgctatcccggctcactgcaagctctgcctcttgggttcatgccattctcctgcctcagcctcccgagtagctgggactacaggcgcccaccaccacgcccggctaattttttgtatttttagtagagacggggtttcaccgtgttagccaagatggtctggatctcctgacctcgtgatccgccctcctcggcctcccaaagtgctgggattacaggcgtgagccaccgtgcccggcctaggtgattcttattgaaatatcataaagggcaagtattgtgacaacttttctccatgattaataaaacaaacagataatctttataatactaatcattgctgtttctttataaaatgttcttgattacttaaagtactaataaattaaaaatcagatttttgcaacatgtagaaggctcttttaaaaaaactataatattattctatattgtatttctgtaggtataatatcacatcaccataatctgcatggtctaataaaataatagactgtttctcaataaatagctttcccacaatatggaaacattggcaatgttttgtttttttttttgtttgttttgttttgagatggagtctcgctctgtcacccagactggagtgcagtggcatgatctcggctcactactacttccgccttctgggttcaagcgattctcctgcctcagcctcctgattagctgggactacaggcatgtgccactacaccaggctaatttttttgtatttttagtagagatgaggtttcaccgtgttagccagggtgatctggaactcctgaccttgtgatccgcctgcctcagcctcccaaagtgctgggattacacgcatgagccaccacatccagccggcaatgttttttaacatgtagtttagtcttcagaccctctcaaattacttactgaactaaagtatgccttttataagaaacaacattcagtaatataaaaataaactctcatctcttctttactttccatttaatttaaggtacattttggaggacattcttgtgcttacttcatgtaacctcacttgcttttaggtgaattcaaaattctaatgttaatcccttgtattagggttctctagaggaacagaagtaataggatatatgtatatacgaaagggaatttattaaggaatattgactcggatgatcacaaggtaaaattccaggataggctgtctgcaagttgaggagcaagcaagccagtggtggttccgtctgagtccccaaacctcaaaagtagggaagctgacagcgcagccttcagtctgtggccaaaggctcaagagcccctggaaaaccactggtgtaagtccaagagtccaaaagctgaagaacttggagtctgatgttcgagggcaggaagcatccagcacaggagaaagatgaaggctggaagactcagtagtctgctcttccatcttctcctgcttcctcgctggcagctgattagatggtgcccaccagattgagggtggatctgcctctcccagaccactgactcaaatgttaatttcctttggcaacaccctcacagacacacccaggaacaatactttgcatccttcaatctaatcaagttgacactcaatattaaccatcttcttactgagcagttaactcataataacactgccaaagagaactctaacagttaacagaagcgtcgtttgttgtcctaagtctgtcataatattctgtataacctttgaagaaacatttaaattttcctctttcaagcaatgaaatatgcattccttaaattgaaagaacatgagcttccttgatgcgttgcctgacatggtgggaaaggtgagcccctgagtcggaggactcatcccggatcccattctctcacaggcttgtgaaagcagaagtcaccttccttctgaccttggcatgtatcctgcttcaagaatggaactggaggcatatctattcttattacaaagaaaatttaagtcattctcctatagaattttaatttcaatcattgttttaggaatttgcaaatatatggcttgctttgtcttaactaatagaaaaagtgtcctttttcaaaaagagaagtgttaatgtaatgataatagtaatgacttcacagaatgtgtgttctgttccaagcactttaagcatattaacaatttaatcctcacagtaatccttggaggatgatatcatcctgattttgcaagtgagacaactgaggcacagaaaggccaagccttatatagcagagctgggatttgaacccaggatgtctggctcttaatgctgttagtttacattcttaactgtgggccagatgtgtgtaactgactatcaaacgtggttctgacacaaaattctacatctaaattccaatctccattttacatttctgctaacctgacgggggaaaaacttttattttaatatgaccagggatccacattttgaaaaatattgccagtgcagtcctgacagccacttcttcattcttaagcacctgggaggaaactgttcagaagtggttggttatgaaatggtaaaatcagctctgccctgctgatgaatccagaataattaccaatgactaagtccagcctcatgaccacttcttgagtgacattgagtttgcatcctaatttgaagtttacaattctggcaagatattggacagctgcagggataattttgttcacaaatatagatgcaaaattctatgctgcgttaaagctattttaaagagcatattttaggactagtgtttatttccttgtgtctaaatttcctgttttgcatttgcttcagctaagattgttttgggctaaacttatcttcctacacagacccttgatagcatgtaaatcaaaataatcataggcatatttaattatatgacatttgttgtctctacactaaagtttttctaacattcttaaattttgtctacataatgaatatatttttaacagaaaaaaaaactataggtttgattgcctgcttatttaaataaaaagagaaagaagagatagaagaactatgaactctttattggttgccaaacaataaaaatacctttttggggccgggcgcggtggctcacgcctgtaatcccagcactttgggaggccgaggcgggtggatcatgaggtcaggagatcgagaccatcctggctaacaaggtgaaaccccgtctctactaaaaaaaatacaaaaaattagccgggcgcggtggcgggcgcctgtagtcccaggtactcgggaggctgaggcaggagaatggcgtgaacccgggaagcggagcttgcagtgagccgagattgcgccactgcagtccgcagtccggcctgggcgacagagcgagactccgtcttaaaaaaaaaaaaaaaaaaaaaaaaaaaaaaaaaaaaacctttttgggaaaaaagtaaaccccattgtttccttgaatgtgcttgttctttcagctcagtcctaagagtggatgattactgagcacagggccctgagatgaactgagggactcgcatctcattcaagcctcacaaagcagtggaaggattaacgttttcttcattttataaagagcacactgagactaagaatggttgattagtttgcccaagttctcaagagtagtaaaattttgagccgttaatttaaaacagaccatctggaggtagactagagctgagaatgatctcaattaaaggaaggaattctgtcactttgtgaagttttatgaagagataagatagaaaccaacctactgagtattaaacaaaaggctatttcccgaaaacatccttccacattcattcttcaatcagtaaaattttactaccattaaggcagaaaaagggttagacacaattccttccttcaagaagtttagaggttaatagggacactacaatattcgtgacataacttaaaagctacataaaaacagtatagaaaggtaaagatttctctgtgaaagaggtataaaaaagaaaatattttcctcatggtaagcttgaagtttcttcctccctgggaggcttaaaggagtcttcgtgatggagatctagaatccatctttagttggttagtgtgtgcacatatgagagggaaggccatgctgggcctgatccaagaatgaggctggaaatgggtgtacttttaagaaaatgaataaataaataaatgatcttgtttgcctaggagcctgcaagggactaatggaagctgtgaatagaaagaccctttggaaccaatttggagatgtccttgaaaacgaggggagtatagaattttctccaaaagaagataagaaacctttaaaggattgtatctgcggaggggcaagatagtaacaaaatcttcgaagaggaaataagcctttacctcaccgctgttcaccttgtttgagggcttacctttcacagcatgggcccctgctcctggccctccccattgcctaggcagagtttcactcttagcctctgtcaagtgtgatcaccagctgacttatctatatcttttttttttttttttttttttgagacggagtctcactctgtcacccacgctggagtgcagtggcgcaatctcggttcactgcaagctccgcctcccaggttcacgccattctcctgcctcagcctcccgagtagctgggactacaggcgcccaccaccatgcccagctaattttttgtagatttagtagagacggggtttcaccgtgttagccaggatggtcttgatctcctgacctcatgatccacccgccttggcctcccaaagtgctgggattacaggcgtgagccaccgtgcccggccatctatctcttcttatcagtaattgggcagtcttgatactgagcttcccagctgtggacccacaactaaattaatgtaagacccaaagatctgaaacgccctttaagatgccacccttgagaataaagaatgttagataccagcagaggtttatgcaagaagaagatggagtggtggagaaaaactgggagtaagaaaattaaaggaagagaaaataatagaaaagaacagtgatcatttgtattaaataatgagagtgaaaatagggctaacagtattttacaggtgtagtggatcacaggttgttgacatgtaaccaacaagaactggacgatatggctgcaaccctttgtctgcaaaagctcacatgtattggctagtaatgttcaagtaattaagaggacattaatcagttaaatatctatccacacatgttttctctaaaaaaattcaagtctccattttttttctgtctaatacttctgacttcaaggatagaatcaagagaactgggaccaggaattgcaactattgcaatgaggcaaatccccacaatgtcccaggtcagagttgagagaggcagctaaacaatgggactgtacccacctatgacatgaccttttaaaacagctctttttttgtgcttctttagatggatagaagtgaacttatatctatgctttgatttttgcaaaattcttagtctgtaaaagatatagttgtgactaggagactaactctcatttgcctcagtcctaaattcagtgtgttcagtataacattgaggaaataaaaatcataataatgatttcagaagtgacatattaactccatatttttgaaagaaagtgtggtcaggctctgtgctaaaaaaaattctacctactgatgttgcaaaagcgtgtcttgagatgatctttacaatgaaaactagatttctgtgaatgtgcaatgacttttgggtccttttcttttcatattcaaatattatttcccttctgtgatatttccccttatttatgggtttctttaatcatatgcatatattttttatgttgaaacctagtaaaggtataagcttttgtttcatttttagcatgaacctaagaagctcttccatcatgatctatggctttcattattgattctgtttatagacaggatataaatataatatgaaaatcaaaaacaagttttaaacaaaaattgtttttaaaattagatttttctcttcaacttaaatattttacccttccaaagggtgagggaagggggaaagatgaaagtggcagaattaatgtagaaataaaatgtttggagcagagcttgggctttttcccatagagtgaatactaaattttatcagtataatgatccatcacagtttaaagaagcaacacattttccaattacaatgataacttttaacatatctaacattttaacatctctgtatcttctaatatattagacttgaaaaattctgtagtgattgcttgtctcagcattttgcaaacatcatccttgctgtaccaaaacagagttcgccagttttggaaagatgtgtgcgtggctgaacctcttctgggactggacaacggacagcaactactatacgtgcaagtagttgttctctggtgagctgaaacagttactcacatcacttcccatgctctgaggttcagatgaggagcgctggtagagaaaggcagctctagatctttgtaagaaggtaataagacacgaaactgtgcccttcaatggaaagtattaatataatacatctctccaaggaagggctgacaatgggagttgaaagccaccagacagtaagtggctctcaaaatgagtgggaaggtagttacacaaagttggtgcccccatacttgtctggaggcctagctgaagaaccaatcctagcatgcccctccaatcatcgtggccactctaggaaccagccctagccacagccctactaggcaagagttgtcatgcttcttttacaaacttcgagtagacttaaagttttccttttgtcttcttcaccagagaaagaaaaagtttacttttggacaggttgcattaaagcactttagatattctcttttctctggtggaagcccgtatcttaggagacatggggaacctgctgctggctcacctgtcacagaactggatcatgaagctttcatctggtttttcccaggtgggcattttaaatttctgcttcaaagtctgtctttgtacttttaataaataagacatttgtactgatggaatctgcaagacaggcttgaaggaaaaaataaatgtctcaaagtgaaagtcagtttctttttacatgaacagtcatgtaaaaaatgtattaaaaatagcctttttgacttggagatctattatgttcagtagctaaactataacacagaagaccacatggagcacatacatgaaatattgttgaggtggccatttggagtcctgggttctagtaaggactccacttcaattggccgcatgatccaaggacgggcatatcacttctccaggacttagggtcttcatctctaaagtgaaggctgaacataacaggtacccttaaagctgcaaagcatcacacaacatttcacacctgtttaccttctcattctcttagataacactttttctctcttttctctttcctcaaaatgccagtgtctcttctcccagtctcattcttagctccctacttcaccagaaaactgaggcaatcaaaaaagaatgtccatgagcttccaacatcacattggcttatggctctgatctgaatgtgtctcctccataattcaggtattgaaacttaatggccaatgtgacagtattaaaagatgggcctttaaggccatgcgggctcctccctcatcaaagggataaaggtctttctaaaagaggcttcacacagcgtctggccctcttgccatgctaccttctgccaggtgagaatgcagcgaaaaggacctcaccagatgccaaaaggacctcactgtctccttgatcctgaatttgtcagcctctagaactgtgagaaaattaatttcttttctttttttttttgagacagagtttcgctcttgttgctcaggctggaatgcaatgacacaatctcggctcactgtaacctccgcctcccaagttcaagggattctcctgcttcagcctcccaagtagtgggcattacagttgtgcgccaccacgcctggctaattttgtatttttagtagagacagggtttcaccttgttggttaggctggtctctaactcctgacctcaagtgatccactgccttggcctcccaatgtgctgggattacaggcatgagtcactgcacccagccaatttcttttctttacacattactcaggctgtggtattctgttataataacacgaatagactgagaccaaaattgataccaggagaatggagtgttgctacaacaaatacccgaaaatgtagaagcagctttggaactgagtaatgggtagaggctggaaccgttttaaagggaatgctgaaaaagcctgtatggcccaacatggcacattaagggtgattctggtgagggctcagaacaaaaggagagctgtagggaaagcctgaaccttcttagtttatcttagacaagttcttatattatctcagtggttgtgacgagaatactggtagaaatatggacagtgagggcctttattatggtatcttaaagagaaatcagaaacaccttactggaaactggaagaaggccatcactgttacaaagtagccaagaagttggctgaattatgttcctgcctcagtattttgtgggaggtagaacttaagagtgatgaactaggatacttgatgaaagaaatctctaagcagcaaaatgttgaaggaattgcacggcttctctcaactgctcatagcaaaatgcaaaaagagagaaatgacttaaagatggaatttataatcaaaagggaagctctcacatgtaaagaatgtaaagatttgaaaaattctcagcctggccatgtaaataataaaaaagcatgtttagtagagaaaaccaagggtgtgcccagttgacagtccgataagcaaattagtgtgaatagcaggaagccaggagcaatttatcaagataatgagaaaatgaccccaaagacatttcagagatctttgaggccaccacattcttcacaggcagagtgctagggccttgggggctgaacaggtttgagggaggggcccagggtgcccatgggaacttggggcttaccatccagggccgcctcaaatctctgctccctgcattctggcacagtgctccttggctgccccagctatggctcaagcaggcccaggtgtgactcaagtcactgcttcaggaggtataggccatagcacttggcagcacccatgtagtgcgaactctgcaagtgcacagagttcaggagctttgaaggcctagcttcctcccctaggtttcagagaatgccacagagtgtctccaccagaggaatacacagtggagctgtgtgagtggggccacctcagagagtactcactaacacaaaatctagtggaactatgggggtagggccatgctggagacctccacattttagagtcaccaggatgcaatgccagcgtgaaagagctgcaggtaggagactccaacccatgagggctgtggtgtgggctgtgcccagcaaagctatggggttgtggcctttggagccttggggatccaacccctgccccagtctgccttgacggtaaaacatgagtcaaataaaattattttcaagccttaagatctaatgttgtttgcccttttgggttttggatttactcagaacttgttacccctttcttttagccaatttctgcctttcaggatgggaatgtctatcccacacctataccaccattgtgttttggaagctaataacttattcgactttgcagcctcattgctggagggaaatttgcttcaggatgaattgttccttgagtctcactcatacctgatttacataaacctctggactttagacttttgagttgttgttggaatgaatgaaaacttttggggctattgggatggaattaataatgtattttgcacatgagaaggatatgaattttgagtggccagagaagaatgctatgatttgaatgtatttctgccaaaattaatatgttgaaacttaatgaagaatgtgatcatattgagaggtgaggcctttaagaggaattaggccatgaggattcctcctccatgaataggattaaggactgtcttagtccattttatgctgttacacagaataccacagactgggtaatttataataaatagaaatttattggctcagtattctggagctggaaagtccaagatcaaggggctgactcctgcctagggccttcatgtgtgtcctttcatcgtgaagggcataaaaaaggggtgagagagaaaaaagcaggccaaataggtccttttatagggagcccactcccacaatagcagcattaatccatttatgaaggcagagccctcatagtgtaatcacctcttaatactattttaatgataattaagtttctaacacatgatttttgggaggacacattcaaactgtagcaaagcccttaaaaaacaggctaaatgcagcatttggctctcttgcccttctgccttctgtcatgtgcacaggcagcaagaagggcctcaccagacatcaaattctggcatcttgatttcgggcttcacagtttttatacctgtgaaaaaattaatcacccaatctgtggtcatctgtcacagcagcacaaaatgaacaaagacacttacccaccagtacctacaccctcagagtctgccttctcaccttttaacttttaaccttttaactacccttacacatatacaaagctcatacttcaactattcaaaaatagaagtcgcaagattagctcacctctggcctttggatttttccttggaagattctattagcatccagtcctgctatattccctatccttaagggcacgacaacaatagaacacaaacaaaaagaaacttttcttggctttactttctctgcgagctcctgtcccatttctattctcttttgcaacacaattccttgaaggagttatccacactcttttaaaatatttttctctgttattcttgtaaacacagtccaatcagatttttcagcactccccctacactgctcttgtcaaagtgtccaacaaacctcacattgctaaaatcagtggtcaactctcaattctcacattactcacactatctgcagcatctgatataattgattacgactcttccttgttaatttttttcttgtttcagtcagtcttttggcattagttccatccatatgccactgacttccaaatgtggctctcttagccaacacctctctcccaaactgcaaactaaaattccaaaaggcttatttgactctttttagatgtcttagagatatctcaaacttatcaatgttcaaacctgaactcctgatctttgcattcaaaactttgtttacctgtaaacttcctaatctcatctggtggaaactcaattctcacactagcttacaccaaatatttaagagtcagactcatttgatggtctcttatgagctcacacttgcagtttcactcctatggagctcagccagggctagaacttccattatggtttaaatcatatggctggtagttgtgctgactactggctgactctggggctctgttctcctccgtcagtctagcttagctttctatcagcatggcagctgcattccaagacataaaaaatggaaggtgtggggattcttgaagttttgtctttggagttgcacattgtcatttctaccacatgatattggttaaagcaactcataagattagtccagatttaaggggaggtaagatagagtctatgtcttgatggaaaagtggaaaagtcatattgcaaaagggcatgtaagatagaatggagtgttgcagtcgtctttggaaacaatcgaccgtataggacatcttcaaattacaaaataagctacttgccctagaatgtgccctctttccccttctgttacaagcacatgacccagctgtgattaggcagatatggaccataccctagggcatggaatagcaaaaagttgaaagaaacctgtacttggataatcatgcaaagctgagttgctcatcccatgactgttaggtaaagacaaaaaactttcttccatctccgtttctacccgttccctttcaccctcaccccttgtatctttgatgttccctgaactggccaggcactctccagccttagtccttttaattgttctgtccacctgaaacattctttccacaaatatctacagagctcgcttcttcacttcatgcaagggtttatttaaatatcacccacttaataaagtatttttgaccacactttttaaaataaaaatccatgactaatgaagactgacacacatttagtcctttgaacaatatctagataaaaatgtctgtggagtgaaaagaataaatgctgactttgctgttcactggttttcttcaggaaagtctcattatttctcagactacttcatcagaaaatggagataacaatggctttcttttacggtcattgtgaaacttagatggccccgtgtttgagaagtcctccttatgaggtcgccctcatgattgctcttcacttgagttcaggctcccgctctttgtcactcccctttgtggagacagacagactttctggagctgactaaccttgactaacctctcactacccaacccacatctggctacaggggaaagaacattgtcacaggaactaggctggttgtaccatccccacaagagtgtattcagattcttcttgagaagagtctagaattgcaccagaactctgatccccagcccaaaagcttgcatcaatgtggtatttttataaacatgtacatactgaaatgactaccataatcaagctaattagcatatccatcacctcacatatttaccttccttttttattgtatgagaactcttaagatctattctcttagcaaattccaagtatacaatacagtattattaacaatagtcaccatgctgtacattagatctccaggacttatttctcttgcataactgaaattggactctttactcaacgtctcccaatttcccctacccccaacccctggcaaacattactctatgctctgctacctggatattttgtctctctacgtacattttagattgcacaaaataatttgctgttgtaatgaatggcattgcactggatccacaaatcaagttaggaagacatcttgacaacattgagtctctctatccatgtatatggaatagctctccatgtatttagttctttgatttctttcatcagctttatagctttcctcatacagatcttatacaaatttggtagatgcatacctatgtttttaatttctaggggtgctaatgtaaatgatattctgtttttaatttcaaattccacttgtttattgctgatgtataggaaagtgattgatttttggatattagctgtgctcttatttttatttccctcattttccttgttttgaatttactttgttcttctttcttatttcttgagtaggaacttaagagtattgacttgaggacacaaatgatgctgaatagccaaaacaatatttagcaaaaagaacgaagctggaggcattatactccctgatttcagaacatgttataaagtgatattaattaaaaccacataggtactcctataaaaacagacacattgaccaatggaacaggatagaaagcccagaaataaacccagccacttgatttttgacaaaggttcctagaacacacagtggggaaagcacagctttctcaataaatgctgtgggaaaaactgagtatctgcatgtagaagaatgaaatgagatccttatatcataccatatacaaaaattaactctaaattgatgaaagacttaaatataagacttgaaactgtaaaactattacatgaaaacagagaaaatgatccaagatattggtttgatcagcaatttttttggatataaccctgaaagcatagggaacaaaagcaaaaataaacaaatgggatgacatcaagattaactatcttaattatattatttgatgaatagaagtcattaatttatagaagttcaatttaataaactttaaaaatatttggtgtctttttggtcctatttaagaaatctttgcctatctcaaggtcatggaagatattttgtacttttttgttatagaatttgtattgtttttactgtctaagcttccacattgtggcctatgatccatcctgaataaatgttgctaaaaattaaactttgacttagcttactataaatgatatttatatttatgtattacataatttatttacatattctcatatgtaatacatattattttactataaacactataattaaggcagaatagatagtttagatacatattcatgaagatgccacttccattcaacggacaaaaggatagtcttttcaataaaatttactaggtcagttagatatctgtagatgtggtgggtaattttgtctttaaacttggctgggccacagtgcccagatatttggtcaaacattattctgaatgtttctgtcaagattttttcatttggataagaataatacataaatcagtggacttagggtatgcacattaccctccatagtgtggatgggccttctccaatcagttgaaagacttaatagagcaaagactggccgggcacggtggctcacgcctgtaatcccagcactttgggaggctgaggtgggcagatcacgaggtcaggagatagagaccatcctggctaacacggtgaaaccccatctctactaaaaatacaaaaaattagccgggcgtagtggcaggcacctgtagtcccagctactcaggaggctgaggcagaagaatggtgtgaacctgggaggtggagcttgcagtgagctgagatgccactgcactacagcctgggcgacagagcaagactctgtctcaaaaaataataataataataataatagagcaaagactgacacttcctgagcaaggaggaattctgctagtagactgcctttggagtcaaactgcaactcttccctgggtctcgagcctgctggcctaacctgtagattttggattaaccaagcccttacaattgtgtaagccaattttaaaaaataaatctcttgatatagataggtagatagatagatagaaggacagatagacattctgcttttctgctggttctcttttcctggagaaccctgactaatacaattcggaaaaacacgtatcttgacctgcacttcaccatgcacaaaaattaatttaaaatgaatcatagtatcctgctcatttttaattcttcagataaaaatttacctactatatctttagaataaacttttaataaaagttaattaaaattaagttttaattttatttttatgtttttttctctcccttgtgaaacagtagtacacttgaaaacaggagaattttttttaatgttaccaacgcagttcctggtaacaaatttttagaggctactatgtgtcaggctctgtgataagcattttaagcactttacttccataagtcctcggaataatcataccctcttatgtaagtattattatgaccaccaaatcacagataagaaaacaagcattagagagaaattaagtccaactgattctaaatgcaggacgcttgtacactaggtctccctacatggctcctcaataaataaattcattaagaaataagaaggggctgagcgcagtggctcaagcctgtaatcccagcactttgggaggcctaggcaggcagatcacgaggtcaggagatcgagaccatcctgactaacatggtgaaaccccatctctactaaaaacacaaaaaaattagccgggagtggtggcgggcgcctgtagtcccagctactcgggaggctgaggcaggagaatggcatgaacccaggaggcagagcttgcagtgagccgagatcgcgccactgcactccaggctgggcgatagagcaagactccatctcaaaaaaaaaaaaagaaagaagatgggcttaaagtttcataaaatatcagtcatatgagaataaggaaaaggaaaaaagaatgtaaatgaaagataaagacagagaacaagaagaaaacacagcggagaatcagaaataaagaagattgttgaaagaagagaatatattactatatttatttattgaatatattgattaggctctgttctaggtggcgggataaagatagatgtattatctatgtaaataatatataaataataaatatatattacataatttataaacaagataaattatctatttatagtccaatcatgaagatggcacattaatacctgacaataacaggtagaaatagagccagtgaagatgagacagaaagcatcataaggatcgggaaacacaaggacaacatggaatgggctggttttggagttttaactctgcctcaagaagttatggtacttgcctaagcaaagaggtggaagtcttacagaaaaggaaaatatgaacggacatagctgagtgttggaagaaaagatgagggttgagctaagttgagctgccagggtagagagtagggcagaagttaatttccaacaaggtgctcagaaggatctgatcatggaaagtctgggttttatagatttcatccttttaacagaggagcagctaaagcagacctttcctttgggacgattgtcaggacggaggacacagggtccgttagagaagggtaacagaagtgacgaatgaccatggaagcttatgggtggtttaggcataaggtaaccagggcctgagaccagagaaattccagcagcaagagaaataagagaaaatagaaatgggaagtataggaaaaggaaacattttaaagctcttattccatctttgggcgaggttatacgtatacggtctagagttttttctcttgttgatggtgaaagggaataaacagcatgaaactcaccctggaggctaagatagtttgactcagagttccccccaccgcttgacctttcatgaccctgggtacacactaactctgaagttagtgggcaaggtgggcaggggctcatggactccataaaatccatctgactgttagctctgtctttcaccaggtgggggggccaggggctgtggcttaacctcattgtgcctcagccaattcttctgcatgtaaaatgaggatattcactatgtggccattgtgagatgatccatgaaaacctgtgtagcactgagcacagtgttctcagtaaatgctgagccctaatacccaatatacccacagctccatgcatgtgctccttagcaagcatacgcagacagcttggcttatctgcttgtgtcacattataaaagttggcttcctggttatttctacagtgcagcccataataccgatttccttaagagcaaaaaaaaaaaatgccttatttctttcctcaaaaatgagaattggccttttaaaacttttcctcaaatgacaggactggtgctgtaaatgcttatgaagactggtccctttgcatgtacgggcttatcttcctgaagatatgaagctgtggctagctgctttcttctgtttcctaacgaccacagaatgcacaaagtagaggtgcaagtggaagctgcaaagagctctacaacctctgtcaaggtgcttgtccttgcccaagctattactgttcttggtggagattattccccgctgatctaaaatatgctctaaggccaaggtgggcggatcacacgaggtcaggagttcgagaccagcctggccaatataatgaaaccacatttctgctaaaaaatacaaaaattagctgggtgtggtgatgcacacctgtaatcccagctactcgggaggttgaggcaggagaatcgcttgagcccaggaagtggaggttgcagtgaaccaagatcacaccaccgcacttcagcctgggtgacagagagagactccatctcaaaaaaaagtaataataaatacatcataaaatatgctctaatgttggagccaaaggtcagcactgtcactacacaaagcctcactttgagtagagatgcctgctgctgctatttcttgggacatgagcattctttaactgagtttaaaagttcttgaattataaatggatagaaatacagcttcacagaggtatgctcataaaggagtcttcacacttgaagatacagtggacacatacacacacgcacacacacacacgtttagagaagttcccttaatcaatctgacagcatgtagttataaaaaacacaaattggccgggcgcggtggctcacgcctgtaatcccagcagtttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggctgagcttgcagtgagccgagatcccgccactgcactccagcctgggcgacagagcgagactccgtctcaaaaaaaaaaaaaaaaaaaaccacacaaattttatgaggtgacggtacagcttctgcttccctatatactatacctctggagaacgaagagcactgaatactatatttttactttctatgtttggaactacacttattatcatgccattactcaacaaacatgcatcacaatgtccccataccaccatgaatgggcacaaataaccccatcctattgtggtggggttaattttttaggacagcaggtgctgtccactgttaagagcgtcagtttgcctgattttttcaagtttattctccaagagcctttcactcaggttgggtctgcaaagcaccagcaagtccaacaactcaaccaaatgtctacagctgcgggtggcagataagtatagcagctaacccaaagcaaataaaaacaactcctaggggaaataagagggatgctgggagggctttttatttgagtgccactgtggtcttactgatttgagtgcccacttgtttcagaatttagggtgtgggagtgaccaaggagcacagtgactagaggaaactagaaacaaaatagacattgttcactttggttgctaaatttaatatgtccctattgcactttttgttttgggaaatttttccaacattaagaaaagcccttttaaagaagagtgttaaaacattggttacatgagaaccaaggaggattcaccttacaaggtgaaattatgtgttttattcaattttcacactactataaagaaatacctgagactgtgtaatttataaatgaaagaggagttttttgttttgttttgttttcactcaaaattcttcagtttttacaaaactaacagggtggagtggggaggctggggggcaggcagcctcaggagtagggctggtgagaggcgctatgcttctgtctccacctgagactggctccctgccgtgttgctcttccactccgccttcatctctgtgtcagtgggatggtctcctgagcaagcctctgccttggccttgttctcctcctcagccagcctctcaaacattttggcatagaacttcttccgggcaagctgcctgtggatccgctgctgacacacagccagctgggccctggcggctttgttgttggggtagagctgcaggaccttctggaagtcagcccatgccagttcaaagtcattcaccgccaggtgggcctctccccggcggaaggggcccttctcgttgttgctgtccagttctagggccttgttacagctttcaatggcagcagagaaggcctgtagtttcagctgacacatggccaggtcgaggtgagaggccagtggaggggcctgtgccttctgtgcttcctcattggaaaaactagacatattccagccaggacacaatcttcttacactgtagtaaagcttgcttgtatttgccttccttgaagtacacactgccctgctctttcactacggtgttctgttccagcttctcttctgaaatcatctcccaagattccttggccttttcaaaactcttgagatataattcatatttcagctcggcatttggtgggatttggaacttttccttcccaacactgccaaaagcatagctgggcttgaggtacacagtggaatgttctcctttctccaagtgctgaatggccctctcgagatcataaggcagatccaggttctccccctcactaacctcaaagcggagcgcccgttggtcaaagagctggtccttgcagcacccttccagcgcaacctccaccatagcgccctcatcgggcttgacatagccttcaccgtgagtccctattctgcggatgattcccccatctttcaaacacaagcgtggcgttatggggagatcgttggaggactgtctgctgaactctaggcatattctggtttgcaggtgatgtggcccacctcccccaccttcatggttgctacggcaatgtcccaagccttgatgacctccccttttcccaggtcaaaggagaatttgtccttgcgatccacactggagtcaaactttgtgccctctaacagccagccagtgtagtggacaaagactaggtccccagtcatgggcatctctgtacctgtgccctctgtcttgatgactttcagcactccttcatcctgtttggggctgacatccacttccttcttgggcagcggcaccggctgcgccgcactctcggtcgccttcatctccttggctgtcatctctgcgtggcgcgaaatttttccgggagatggcgcaggcgcgagtgcactctgggccgcaggcgggggcgctacctgcagggcatgcgggaggacggacactaccgcgctgactgctgaccgcgcggaggctggagcacctctcaggaaacaggtttaattgacacagttccacgtggctggggagggctcaggaaacttacaatcatggcagaaggcaaaggagaagcaagtatcttcttcacgaggcagcaggaaaaagaaaacaggcgaaacttcctcttacaaaaaaaccatcagatctcacaagaactcactcaccagcaccagcacagcatcggggaaactgtccctgtgatccgaccaccccccaccaggtccctccttggacgtgtggggattacaattcgagatgagatttggatggggacagagagccaaaccatatcagtatgtctattcagaaaaatgtttatacatatatatatatatatatatatttttttttttttttttttttcagagtgttactctgtcacccaggctggagtgcagtatcgcgatctcggctcactgcaacctctgtctcccggattcaagcgattctcctgcctcagcctccagagtggctgggattacaggcgcccaccagcacgcccagctacatatacatatatgtatttttagtagagacagggtttcaccatgttggccaggctggtcttgaactcctaacctcaggtgatccgccagctggtgtaagccactgagcctggccagaaaaatgttatttatattctaatggtaccaacttcaatacgctttatcactctgaaccacagttttttaatttaataaggaaaattgggtagaaaaatatattaaaatatatattaatctatcaaatactacacaaagacaagtctttaaatgggttgggcaatatgctgaagttgatcaccagtaaaacgttgagtaacccctccatagaattcccatagaaatctcttcgttaccataaacctaagatcattgctctctctcactaccacagggatgtgattttagcatttgtatccaatttaccggtagcctaagccatcagtgagatatttggcattctgtatctaagcctgttccctcaccaccacacttcttcatttctcttggttctattctatctgtagaagacactgaaaagtgacgagatgtgctgttgaaaatctgtttcaaaatcatacactcattgctcactaaatattagctcttcagtcccctggaggtacctgggatcagtctctcccgcctctctatgtagaagagggaggggtactctgactgttgggcagttgtatattctctcggttttcaaaaatgtctactaattaaatgccattggacatgtgctcctacttcctgtgggggatgagacacagtgtgacacaaaagacaaaatgtcctttctgtacgttattatgtcgctttgttcatattctgtgaccctacacatttataatgtcacctttacctttcattatgttcatatgtgcacactatattctgagacccctcatttcattgttgatttgtccatttctgaacaaacagcagttttaattattttaacttcagacttttcagtacgaaaagtcatatctgatttttatcttgcttgaaaatgcttcttactcgtattctcctcaggatgaaattcccctcatcccgatactcagtaacctcattcattccatccattccacctgactttctccccatctattagctcctgctgtattcgtttctcatcttatcaagcttaggaagaatatcgtccattatttaccatttcctctcttgtatcattagtcaaaactgtgtttctccaagtgtggtccatgaaactattgcctctgaattaccaggggtacttgctaaaatgcatattcctaggccccattcaatctggaatgaatgaagcttgaaatctgcaaatggaatatgcgcctctgaagtacattatcatttgatagctgcttccctagcctctctgcccatcgcatggcatcactctcacaaaccctgactcaggatgaacctgcctttctgccttcttatggcctttaactaactggggtgagtggtgtgactgaacgagcattcaccacaatccacttcaacaggcttcaaacaccactgataatcctgatacagaagtcagcatctgccacacattctccctatcagcagtgacccaagtgttcagtcccagccagtacctcacttcacttatattaagtttcctttaatgggccactgttgctcttttctcccaatacttgtgagtctgagacaccctagtttatcaaacatgttctaaatggcactgaagctcaaagagaaatggtctggatgccacttcccttctgcacaaatggctcttttatatctctataaatttgcaaatgaaaaatagatacttctagaagcaggagcaacctcacttatcagaccattgataagacaaacatagttacaaccatcccctgaaccatgcattgggcacttgccttatacctgttatcatgagaggtactgtccaagtggttcatgccagagaaaaagagagttttcccaatgtaaatgaaattaacctctaaggatttaatacttctagtaatttcaaaatgattttaaaaaattaaacttcttctttgctccttaaatttccctgtacctcacactataaatgagtgcacaagaaagataaaaaaaaagatggcactaaaattttagctgttatttgggaatgatgaaaacaggagtgattttttaattattatttttacaaagtaacatttattaattttgtaattagaaggaagaaagataatatttatttcacaaatatgctccaacttgaaaatgctttgaagatgaggggtgaggtcagcagcccgctgtgtcagtaaggtacttcagccttgggtcctgtacacacttacaacagcaggaaaatctggtgctttgggaagaggtgtccacaggggctaaggcacaaaataagagggctgcatatggactgtgtgaagtaataaattcctgaaggcctgcttattctatgtatttaatatttaaaattacccattcaagcatggaaaagacaatttagggcctttataaccaaagaggataagaatgatctgttctccttaatggaaccccagagactagaatttaactatttcctggctccattccacttctaccaccccaatttgagtctagaactcaaagtaccattcatcctagattctatgcacacgtacaaatcatcacatttgttttacctagaagtgtaatggtaacttagtgttgcaagaaaagccctatgtctattcagaaaatgttatttatattctaatggtaccaacccctcccttgacttggctctgtaaccattctggtaaaaaggaggaattaaggtaaataagagggattacgggttgaagatggacaatcactcaaaacttgaaaagaaaaagtcactccactgcctaaagcacttcaatgattgcccattgcattcagaataaaattcaagttgcttatcctgacctttgaagccctaaacccttccattcctctgcctttctcagtttatcttatgccagtctctctctatgccatcctcatggacatgaatagtcttctttggtctgaagattattcttggttgctttatatactgcttaataataagaagacatttgccccctttgaattccaaataagataaaagaagtggctggatgttatcacaagtacaacatttctgtttgggaagtatggaatacttctcagccataaaaaagaatgaaattatattttttgcagcaatatggatggaactggaggccattatcttaagtgatataactcagaaacagaaattcaaagactgcatgttctcacttataagtgagagataagtaatatgtacccatggacatgaaaagtggaatagacattgaagactcattggagattttggagactccagtagacactggaagggtgagagggaagtgagggatgagaaattacctgaaaggtacactgtacactatttgggtgatgggtacactaaatgctgaggtttcaccagcacacaatatatccatgtaacaaaactgcacttgtacccctaagtctatttttaaaagtgattaaaatccatatgttctccccaaccagcatttgccagaacaatggtccccatgcgcctgcagggacttgaccaactattagggcaaaggcctgctacttatctacttccatggtgaagaaaaccacaacagctttggtgagcaagaatgtggaatcctttgaggaacctctgctagggtccaacctgcagaccctgacccagcgatggatgaatgaagtacactgacacacagatattctgctttgccagtccagctgagtgtctgagccacctacagactcccaggagagtactgtaaacagttgcaactcctcgatcagtcagtgagacttgcatttatttagtaaagattaattgacaaaggtcataggaaaacaccattagagggtaattgacattgtggacttcctgagtagaaagcaattaagcacccagggtacatcaaaggttagtcttaggaaaacaagttagttagataaactactctacattattttgtatttgtgccttaagctctctagctcctgcaaagagactctggctgccttcagccagacaatcagaagctatgcaaactctcaggctttccaagagagtttgtggctattactataactatcattaatatttttccaactggcctgattgaacccccacaaaactcaacttcagcagagagctggaagcagggtaaggaactgcagttgccattgcaattcattgagaataaagagaaactaaagggacttcaaactcatttgaataaccttagtctctttgtgtcgtagaatattcttaaaatactttcaagataaatcatgatatgactcacagagggaaaagatctgtcattttggagaccttaaaatacttgatttttaaaaatgtgtgcattttacttacccttgtgatataaagtactaagatttcacaggggttgtgtaaaaatgtgcattttatattcagagaaaaggctgcaagcacagagatgtcacttcagggattcagtttctagttgttatcttattgtcaatcctttcagcttggtcatctctatatccccacacaccagctcattaaagtaagatatttgctatgttttatgtataatatagagaaaagcagacatcactttccataactcatatgtttctgaaatgatatgtactctttgtaagactcagaaatcatccctctctgcttacctaattaaaaagtagaaaatcaaatatttctggtatgatgctgcttttcaccattttaaatatgactagaaaaggcttgcatgcaccttactgtagaaataaaggtagactacccacatgagaacaggtgattaattcaaagtttgggagtgggaaagctttagagtgagcaaaaaacgggagggaaagcgtgggggaaggcttcaagtatgctctgattgcatgtagttggcaaggggaagttggaagtaggttaactagaagcagagtatcttatgtggttggtttggggaacatattttgctttatttggttggttctaagttggaaacaaggcaaaatagggaagctaacagtcattaatgatatcctggaccatttgggaccaatcactgccaatgatgtggtttggcttcctggactggtggcttcagagattgtgaatcagaattctattgtcatatcatctgaccactattcatttgaatatttatcctctcagccccccattacggtcattctcttacgagagattgaccaattcaggggcagctagaaacccacatcttcaccactgtgatattgccgagtggtctccattacaaactatattgtgaggtcttgactttttgttgttgtgtcagcactgagatgtgaggtcagttggacttcctgggtccagtggggacctggggaactttcctttcttacaagaggattgtataaagcaccaatcagcactctgtaaaatgcaccaatcagcactctgtaaaatgcaccaatcagcagattctaaaagtagccaattgcccggaggattgaaaaaagggcattctgacaggacaggaacagaatatgggaggggccaataagggaataaaagctggccaccccagccaccagtggcaatcagctcccccttccatgctgtggaagctttgctcttcacaataaaccttgctagtgctcagtttggttctgtgccatctttaagagctgtaacagtcacagcgaaggtctgtggctttattcttgaagtcagcgagaccatgaacccaccagtaggaaccaactccggacacagtatggcaatgatctctggtgagaacagctgcccagtagaatgtaagacttggcagaggttgtgatggacctgcatcatggcaggtatgaccaaagtgttgcacgttttgtagttccgtgtgcagggtggaatggcgcccagcggctttttctcccctgttgcttggcgagtgagagggagggttacagtgttacaggattcgttcagtgccgcttcaccagctggaaatctctgtggctgcactgacttctgttccggcccttgctcaggcctgccgggttgctctgcccacttggcccagcaggctgcgcttggctcacattactggcccagatcctgtggtcagtgtggctgcgtgctcagctcgtagctggactgggcatgctgcaattggcttccatattgggcgctggtatctagatgaaggggaggtggtggcgccggaatacttggagatgacagcaactacaaagccccaaagggtgttacagcttttgcttggggagtcctgaggtctgagccccccggaaatgttacagttctctctggttcctgctgcctgcagctcagtgaacaggggtgcgttacatctcctttgttactgccacccgcagcttcgggagttcccacaaccaacaagaataaggtgtgtggacagcagagagtcagaaaggcagagaagaattttattgagcgacagaaaagctctcaacacaagaggggacctgaagtgggtagacttctgtgtgaaagggggcctgaaagccggcagccatctgtgtagctgagtataggatttttaagggctcagaatggaggagtgcatgctgattgggccgggggtggtcttggaaaaatcaccatttattggttaaaaggcatagaggatgttctcactccggttgtggactctacctagaactggcagttgggttttcaggggtcaggctgtctttggcttaaaggtcgggtttcaaaaacaaaaataatcactagtccctataaaatgctacagaagcagaaattctaattttccaccccagaccaagagaacatataggccacagaccatgaagatctgccttagaatggcaattatcttttttccataaggaaatgtgagatgtagagcctgttttactttgcctgtttcgttgattcaaatatagtgagaagtattagcaataacacagagctaccatgagtagccaacaagaaatctagagaaatatggttattattacttgtaacaatagagacaatgtcattaataacttctgccagagttattggtgatgaaactattggtgatggttttcttacagtttttttctgtttgtacaattctcactctgattattcacacagtgagtcagtaactcccccaggtagactgcctgaataatcaagggtggccgcatttggaagctccagtctgaggtggaatttccagacttccgtttggaaactcgggttggcccactgatattttataatggcctatctgaatccttagaaacttctcctttgaagatttacagaagacaataactttaggccgggctcggtggctcacgcttgtaatcccagcactttgggagactgaggcaggcggatcacgaggtcaggagatggagaacatcctggctaacacagtgaaaccccatctctactaaaaaaaaaaaaaaaaaaaaaaaggccaggcgtggcggcgggtgcctgtagtcccagctactcaggaggctgaggcaggagaatggcgtgaacccaggaggcggaacttgtagtgagctgaggtggcgccactgcactccagcctgggtgacagagcaagaatccatctcaaaaaacaaaaaccaaccaaccaaacaaacaaaaacattaactttagttaaggcttttttttggcataacgttctgttagaattttttctttagtttttctattaccttctttctttgtatgggcctcaaccttaaaatagccaactctagaaagtagagtgccttaacttattcattttcatggggtttccagcagagatgatgaatttctttttttccccaaagcatcccaaattcatgtagtactctaaaagcatacctgctatatgtttactacatggtcttcagctaactgacaagctctagtaagtgtaataaattccattatatgggttgattttacctcagatagaaaatatattctaaagtagagcttaaattagtgataattttcaatatcagttttgaggtatgatccatcaatgaataacattgaatcagagttcacaatgagagccagtctctcatcaatctgagtgaggtacagaaactcccctgacttataaccatcatgaggttcccttcttctggcagggggagaagagtggcagtttaaggaattgcatcagtgaatagtaaagcgagagagagggagtaaaactctcataacaagttgatcagctggttgaaaagtattgcatgctctttgtcagtggttatgtctacactggccagggaatcatgatgtgaggtggggagcctagaaatagtttaaaagaagcaccaacaaatgttgcagtggaagctgttgccttaagacaagggctataagcctttgcagctgggtcaagggtaaggatatggaaaatgatgaatttttgatggtttccatgacattgagttaaaaacaaaaaagcttgtacaagttatccatgcacaattagacaaaatggcatattgtagtcaggggtgcctaattatgaaagagagtgcctaactaccaaaggaagaggctactgaagagccttcttgagttacagaatttatatttgggcccccacaaaagacagtttcttactaaggactcagccaattcataaaaagagattgcaagctcagaaaaatttcgcagccattgtctacaatatccagttaaacctagaaatcctctcaattgtcattttgcgaggcatcgaggtgaagtttcgatagtgttctgcctaccaatagaggcaaaataatttcaccctcttaagataacttacaccctaaatactagcctgtcttttgacaaaattataatttatcttttgaaacattatgttctttttctgctatggctgagagcaagtatttacttgctctcaccttctcaccagcttcctcgttctctgaagaaagcagtggagatcatctgatcctgcatatactgcatcaaaactcaatcacaagtgaaatttagatcttttaagtcttgattgaggacttgtggaaagtaagagggggctttagtgagcccctggggtatgactatccgggtatatttgttgtcctctccagatgaaggcaaagtcgttgactgttctggtttggaagcacactgaaaaatgcacagtaaagattcaatatggtctagcaagtggttttgggcagaattgatgacaggataggtactactaggaagcaaagcaaaacaattttgttgatctttcctgaggtcatgaaaaaagtgtaccagcagaacaagtgtggtgcatgggctactgcagcgtatgagaaagtctttggatataaggtcatcaactacagttttgaagcattcctttgcttctggtttttcaaggaatatcagggaagtttgaccatggtttactaggatacttctgaacttgactaggttctgctccaataatttcccatataaatggatttttttagtttgtagagtgttaggtagagtgttgaggtctttatctggagcgtatgtcaaatataatgaaggagacaaacatatatccagagacgacatatagaggaaccctcaggagactctgctgtgcatttattatttttctgagacagagtgttgctctgttacccgggctggagtgcagaggtgtgatcttggttcactgcaacctctgcatcccgggttcaggtgatcctcccattttagcctcccaagtagctgggattacaagcatgtgccaccacaccagctaattttcgtatttctttttttttttttttttttagtagaggcagggtttcaccatgttagccaggctggtcttgaactcctggactcaagtggtccacccacctcagcctcccaaagtgctaggattacaggcgtgagccaccatgcccagctggtgcacttactattataattctatttgaaaattaagtcactccccattaaatttgcaagagtgttataatagagcagggagaaatgtttttaagtcaagtacccaaaggttgtagttacagtaggagatagaaggaatctgtgggttatttgagatacctgctacttgcttcctatgaggaaaatgttgagcaaaattgccagggtttaatgtagaaagagttagtgcctggctgggcatggtggctcacacctgtaatcccagcactttgggggggccaaggcaggcagatcacctgaggtcaggagttctagagcagcctgaccaacatggcaaaaccccatctctactaaaaatacaaaaaaaaaaaaaaaaaaaaagcagggtatcatggtgcatgcctgtagtcccagttactcaggaggctgaggcaggagaatcacttgaacccaggaagcggttgcagtgaaccgagattgtgccaatgtactgcagcctcagtgacagagtaagactccatctcaaaacaaaaaaagaaagaaagaaaagaaagagtagcgcccatattgccaggaattgctgaggttggccacctatatttatggttaattcaccttgaatgttaaattttaaatcaggatattgggtaccttcattgatgtaaattaaggggtcttttggtcttatttttactggaaaatcatttttcaggtgtcccttctgttttcaatatctgcaggtgtcctcttctatgggtcgtccactcaactgtttgatctgcagggccgtaaggttattctggatcctgtcttgttattgtcctagggctctgcaaaaatgtcagccaggtgttgaagttcaggtaaagtggctatttcccattctaattttgatctaattattgtctccaatttcaggtttaattccattaacaaagtaggtaaaagagccgttattacacttacacttctttaacactcaaatgttgttgaaaggggttttctagtttattctgaaaatctcctataatttcttcttttctttatttacatcattaaattgtggtccattttatttttactagaaatgtttcaagtaaggcttttaggatacattgccctactttttgagcctccttttggccctcaggcttattgtggaaagaaagatgctgtagatctctgtcccggtgaatccaactggcttttgccatcaggatttaatgtctgaggatctacaaacataaatacaagttgatatagttcaggtaaccctgagttgtgtacagctaaaagaatttagaattctgaactcctttgggaaatgcttagtcatagcttttaattcagctcgtgttcaaggtttaaattctactgctgcttgcgtatttgggtcattgaagagatggaactttagaggtaaatgacattccgggatcttaggagagtcactgggagaaggtagggggtctggaagaagagggaggagtcaatgaggtgtgaaaggaggatgggggaatgaggaagagttgcagagctgaagtcaactggaggagaagccgggggaagatttgctgggcaaatgagttagtttgttgttaagtttgtcatactgttcattagctctggccaaaaaatattttaacggagtaatgtctgaatcagaatttcatttgaaaacttgtgtaccaatcaaaaactgctgcccattgcccctgagaaatattctctcttttctaaggtgtttttcaaatgaacaattttgttcaagtccagtgttctccagattagccactgaaggcctaaattatccttggtatagagatgggtgcaagtgctaggatcatagcaagggtacatataagaaatgggagattttcctggaggaaaaaaaggaaaagaggatgtacactcagaaaattccatgggagctggcaatggtcagttgaaagtaatatttgtgcactttatgtcttaggcccccaacctgatagttggcaacctccaaatgcagacttgacaacttgtgcccacaggcaaatggaaaaccagaatattccctctgcatcaaatccaacctctcagggccaaaaaaaaaaaaaaaaaaaaaaagatgaaccttatcccattttattggtgactgacaggaaagtttaggaaagtttgtccagatggatgctggtttggtaagaattgcagctcatcagttgtggagcaagctgagacactcttagaggagcaatgcctgtgttctgcactgattctccttctgataacagacaacactttagacttatctcacaaaacagaagcacaaaagagaacaaaaaggaatgaaaagaaatggcagtatttttccaaaggtgccaaacaaatgggaattggtagcaaaagctgagtaccaagctgagagtcaataaccaaggatctcaatacaaagagaacagagttgaagcccaattctgttctctcacagacactgtgtcaacacagacttgacaggcctcaagaagcaaggcacaagaggcctccatagatactgcacttgatcagggtccaaagtccatggtgatgagcagttaagaatgtgtctcagtggagcttctaggaaaattacagaaatacagaccaggcatggtggctcatgcctataaacccagcactttgggaggctgaggcaggtggatcacctgaggtcaggagttcgagcccagcctggccaacatggtgaaaccctgtctctgcaaaaaatacaaaaattagacaggtgtggtagcacatgcctgtagtttcagctacttgggaggctgaggcaggagaatctcttgaacctgggaggcagagcccagatctgcagtgagcccagatcgtgctgctgcactccagtctgggtgacagggcaagattcagtctcaaaaaaataaaaaaataaaaaaaacagaaaattacagaaataaaggagacaacttaatgagaacagaagctatttatttcttgcttgctagagaaagggaggcagtcgctatcatttatgtttgacagagactcaggctgggagaatgggaaagctttatagtgaaaaggggcaaggctttggggtaggtggctatgggcatggagaggtgcaggtaggctaaagagaagcaaggcatctgatgggataggtttggagagagtatttggctttctttaattagtactaaactagaagcaggggcaatcttagagaagttggcagtcattgaccaacctctgattgttttcggcaaattgctactgaatttgtggcttgcattcctgaactggctgctgcagagattgtggtttgccttcccaagctggttgctgcagtggttgtgggtcagagttccattgtcgtacgtggtttggccactgtctgttttaatattcagtctctattactaaaaggtatacaaatggctaggcttctcacttcagttcttcatgtacaagctccttttagaggtttctgcactaaactattgtaaaaaaaaaaaagaaaaaaagaaggccaactccatttatccaatgtcaaccttgacgttaagaatgatgaatgtggcagctgtttccttctgttattgatctttttactgacccttcccattgtgctttgtcaatgactgagtatcttccctggaccactcttatctgaagtcgtcctcatctctcagggattttcagcaccatctgtcagccaggcactgtgactctgtcgtcagtgaccatttttattgacttttgtctctttctggcctttccatggtgccttggccttaaatgtcctgctaattagctcagtggtgattacagtgctggttttgagagcaccctgttgttttttcttatctaggagaattttttttctctctttatctggaaatattaccttgctggctatgctgagttaggtcattgacatcagatcagtgttctaaatctgatcctagtattcccatctacaatcttcccacacaagccaagggaagagacacacttgattaaaaccttgcactctctttcctatttggctattttttctcctcttggagaaagagtttccccaaaatactatatgaagtgttattttgtaagcctacttaacttagttttatatactgtgcacaaactttacatataatttgaataggctcagttttttgttactgtttttttagtttttcaccaaattttatatgacagactatttaagctaaataatttgttatagttagaagactgttttctcatttacataccaaaatctaccaaaatgaatttattacacttaagaatttttgttaattacgattatcacttctgtaaaataaaataaatctaagaattttatgagcaaagctttttcaagtctactatttagtttagcaattattctaaatatcaatctcaaaattagagtaagggatttccccttttaggaaaagatatcaataattatatagtaaaaatttaaaattaagatacagacatttattctgtgttggatcccaaatatctcattagagaatgatcttctctcattgtctgctattttctaaaatacaggaagatataaagtataaatctgattttttttctaccagaagttaaagaacatagaatatatttggtatgattaactgggagtttgtatttcctctgcaatctagaaatattattattttaaatatctgcaatattatttattttaaaagtttttagtttgaaaagacatttctgaaagccccaaatctgtgagcatttgctactacaaaatttttaattgtaagcaattgagagagaaaagtcctcgaatttggccaagcgcggtgtctcacacctctaatcccagcactttgggaggctgaggtgagcggatcacgaggtcaggagatcgagaccatcctggctaacaggatgaaactccgtctctactgaaaatacaaaaaattggccaggtgtggtggcgggcacctgtagtcccactactcaggaggctgaggcaggagaatggcgtgagcccggtaggcagagcttgcagtgagccgagatcgcgccactgcactccagcctaggtgacagagcgagactccatctcaaaaatgaaaaaataaataaataaaagtccttgaatttatgcaaatgacatagcaatcacttcaactcttaaataatctaaccatcatgagataagagaatggatttttttctactcgtttgtatcttgtctttttgaaagagactacttgttaataatatgcttctgacaaaacaaaaactaaggaaagtgtatgatacaggcctgagtctctctcctcaagttcagtttttaaaaataaagtataatcagggataatgtagcctctacttgtaaaggaaggctggctttatgtattaatgaaataggcagcttcttacacgatgtgatttcaacagagccaggaagtatgtcttatctttaaataactccctaaataactccttctaacaccaatatctgaaatgttgtgactgatttctttctgtcctgccctgaagttctttcctgactgcaaagaacagcacattttgaatgtttcaaactgtcatacatgttctctccagaagagtggagtgatgccccaccagacattctaagtcacaggataacatgacatattccatgattgtcagttttaccatgtggcaagtagttaaaaagatgaagtttatagttccaagaacacaaactatgttatggaataggactaaacacaaggagtaaagtagtcccttgtttttgctttaggttactcaccttgctatcagtaattgtattcactgaagtattgaggaacacattaacgttggtttcagatttgttgactttaagttccacatctgaagtatgttggcactttgaccttgcataattcaaagtcatgtctctgcaccactgtttcattctatataaagtgattgacaataatagttatcccacccaagttggacttccatttctgtcaattggccaaactgggtttcctaaaaagccttgtagcgctacaaaatatcagaaaattttatcaagtctacttttaagtaaatgtgaagctctcaaggaagccctgatggcaatccagaaatagataaaagcagtacaggagctacagttgcctggggaacagaaactgacctgggttacccagagtttggggtattaacaactactcaggggaaagtaaaagtaggccttggacacataaaatgttgggaaggctgagccagacttcttgcatatagccgagtcacaataggctaagaacatgaatttaggaaggaaagcaaaaaaatctacaagcagtatgaaaaaaaaatctccaacaccttgatacattttaatgaatcatcagatgacaaagaaatatacaaattcttgaaagtgccagagacaaatcagagattcctagagtgaaaagaatgtccaccttttaatggggttgtttttttcttgtaaatttatttaagttccctgtagatgctggatattagacctttgtcagatggatagattgcaaaatttttctcccattctgtagcttgtctgttcactctgatgacagtttcttttgctatacagaagctctttagtttaattagatcccatttgtcaatttttgcttttgttgcattgcttttggcatcttcatcatgaaatatttgcccatacctgtgtcctgaatggtattgactaggttttcttttaggttttttataattttgggttatacatttaagtctttaacccatcttgtgttgatttttctatacggtccattttctgcatatggctagccagagttctcccagcaccatttattaaatagggaatcctttccccattgcttgtttttgtcaggtttcttgaagattagatggctataagtctgtggtcttagttctgggttatcgtttctgttcccttggtctatgtgtctgttcttgtacctgtaccatgctgttttggttactgtagccttatagtatagtttgaagtcaggtagtgtgatgcctccagctttgtgttttttgctcaggattgttgtggatatttgggctttttttttttggttctatgtgaattttaaaatagtttttttaattctgtgaagaatatcaatgatagtttaatgggaatagcattgaatctataaattgttttaggcagtatggccattttcatgatattgtttttttcttatctgtgggcatgaaatgttttttcattttttggtgtcatctctgatttctttgagcaatgttttgtagctctctttgtagaggtctttcagctccctgattagctgtattcctaggtattttattcttttgtggcaattgtgaatgggagttcatttgtgatttggctcttggcttgcctgttgttggtgtataggaatgctagtaatttttgcacatcgattttgtatcctgagacttcgctgaagttgcttgtcagcttaagaagcttttgggctgagatgatggcattttctagatataggattatgtcatctgcaaacagaaatagtttcccaagaagggagttaaaacaggaacatctcacagccattacagaaattgaagtatttatgtatctcaattaaaaccaaaccatcataaacgtatttctttgaaaaatatctttttttttttttttgagatggagtctggctctgtcgcccaggctggagtgtagtggtgccatcttggcttactgcaagctccgcctcccaggttcacgccattctcctgcctcagcctcccaaatagctgggactacaggcgcccaccaccacacccggctaattttttgtatttttagtagagccagggtttcaccatattagccaggatggtctcaatctcctgacctcatgatctgcccacctcggcctcctgaagtgctgggattacaggcatgagccactgtgcctggccgaaagatttcatttttaatgcctgctaaaatattccactgtatggatataccagaacttactccttgacttagtaattaaatgtatttatattctgtcttgagtttgcctcccatgtttcaaatatactagtcttctcagttacattgccaaggccattatttatatttcgatggtattctcagcaccagctgctgtgatctttgaaatgtattcttgaccttagatgctcactgcacacttgacagattgagaactgagtagaggtgcttgttagtatctgtatctcagtggctggggacagctggactcagcttgtgtgactcatgcaaagtcagatgatcagtcatagagggaacttggaacttaaaagtgtaaactggaacttacgcttttaaaaattattctatctcacatagtgagaaatctttatgactctttagtctacaaaagggatcagtgaacagtttctgtaaggtgacagatgatatggtatagagtagttccccttatccatggtttcactttctgtggtttcaattaaatgtggtcaactgtggtctgaaaatattaaatggaaaattctagaaataatgtataagtttagattatacgctgttttgagtagtgtccctcctagaacacgaatcaccactttgtctagcatatccatgccttatacgctacctgcccgttagtcacttagtagccttctgagttatcagattgactgttgaggtatcacagtgctgtgtttaaggagccctcattttacttaataatggcaccaaagcacaagaatagtgatgctcgcttattgttagaattgttctatgttattagtagctattgttgttaatctcttaccgtgcctaatttataaactttattataagtatatatgtaaaggaaacacaatatgtatagtgtcctgtactactgaagatttcaggtgtccactgaggatcttggaaggaatcccctgtggataagggtgcaccactgtaaatatgttcagctttgagggcaacatagtctctgtcacaactgctctacctgcaacagcgccagacaaatctggctaaactttaatccaacaaagttatgagttggtctgagccctcaggctgaaggtcatgtaaactgagcatgcccagatgaaccaagtatgcaaccacaaggggaagagaagtgcccagaccaaggagaagaccaaggagcagggactgacttaagaagcagacgcagtatggaaggatccaggatccaatcaaattgagctctggcatcagcccattgtgggatcgaatcagatcatgcctcctggaatcatctcattgcagaattcaatcagatcacacctcattaccctatgcttataaaaccctacccaaacaccagctgggggtgatatattggagcacttcctcctgtctccttaccagtccacttgcaatgaagcttttttttcctcaaaagccagtgccatggtcttggcctccatgtacattaggcagcaagcccattgtttgctcagtaacaccctacatttgcatccctttgtatcgtgaaaacagccacagagacaatgtaaatgacttttatctcatttaaatgaattgtcaacctcagctaaattactacttatcatataaacagaaaatgtaaataaactgattatttctttccatccatgtttttactgtcttcatgtatagcatgtataggattttgaagttaactgtttctgaaaacttacttgcaaatttttcaacactgcaaaaattgcttaaaataatgaagccaagaaaattaagccaggttaaaaacataaaagaagaaaaggaaggagggcaggcaggtaggcatttgttaaaagcttctttccctcagcatactattatttgcgattcagctgtcttgttgtgtttatcagtaagttgattcttggccaggcacagtggcttcacgcctataatcccagcactttgggaggcccaggtacgtggatcacttgaggtcagcagtttgagaacatcctggccaacatggtgaaaccccgtctctactaaaaatacaaaaattagctgggtgtggtggcgggcacctgtaatcccagctactctggaggctgaggcaggagaatcgcttgaacccggaggcagagcttgcagtgagccgagatctcaccacttgcacttcagcttgggcaacagagtgagactccttcaaaaaaaaagttgattctttttattgtgagtactgttccattgtataccatttgttagcccattctcttattgatggacagctgggatgtttagatgttagaaataaagatgccttgaactatcgtaagttttcatgtgaacctatgttttttaattctcttgggattagaactgctgggacagaggatcagtgaaaccttaattttttttttttctttttgagatggagtctctgtcacccaggctggagtgcagtggcgcgatctcggctcactgcaagctccgcctcccgggttcacgccattctcctgcctcagcctcccgagtagctggaactacaggcacccgcaaccacacccagctaattttttgtatttttagtagagatggggtttcactgtgttagccaggatggtctcgatctcctgacctcgtgatccacccacctcggcctcccaaagtgctgggattacaggcatgagccaccacccccggccgaaaccttaattttatgaaatgttttttatgttccagaccttaactgatgagcttttaaaactaacttctaaatttgaaatgtacatttaattatggaatacgctttaatgtaatcttttgggataatcacctaatattttgccttgagatttttaatataaataacaataaaataaataactaatagtaaatgaataccttctcaatcttcctaaccttggaatatggggacaggatgtgaaaatatcttagagttttgagatctttacatggttccctcaaggcttttaaaaagagtatttaattgctggcagtggtagcttacgcctgtaatcccagcattttgggagaccgaggcgggtggatcacctgaggtcagaagttcaagaccagcctggtcaacatggtgaaaccccgtctctactaaatatacaaaaattagccaggcgtggtggcaggcgcctgcaatcccagctactcaggaggctgaggcagaattgcttgaacccgggaggcacaggttgcagtgagctgagattgtgccattgcgttccagcctgggcaacaagagcgaaatttcattccaaaaaaagagtatttaattgtgttgattttaatgattactgaaattttggctgtttttttgaaactatttcttgtttcctttctctttcccttgtaaataagctgtaagagaaaactgctcaatcacaaaacgtaacagaaggctttcatgtcagtgtccaataggagtgaattttttatggtgacaaggtagggttataatccagatctctggtaggcacatccataaggtgcaaggtgtgtagaaaatagcatcagtttttttggctgggtgcggtggctcacgcctgtaatcctaggattttgggaggctgaggaccgtggatcgcctgaggtgtcaagagttcgagaccagcagatatggtgttcttgttctcaaagccgaggtgggtggatcacctgaggccaggagttcaagaccagcttggcaaacatggcaaaaccccgtctctactaaaaatacaaaaattagccaggcgtggtggcaggtgcctgtagtcccagttactcgggaggctgaggcagcagaatggcgtgaacccgggaggcggagcttgcagtgagctgagatcctaccactgtacttcagcctgggcacagagtgagattccatctcaaaaaaaaaaaaaaaaagagtctaggatccagagaagtaaactgtattaatgatgtggtcatatccatgccagagcttatttggaaatgcacagaattgattccaagatgttttaataatgcaatctggggtttgcatctcaaagtaatgatccatcaaggatggtctttagagctattttctaactcacgtgcttagtggagactcacatcaaaatgccctgttaataggaatcagtagctggtaaactgaagcctaattcaattggtgtcatttccctgcaaattcgtactccatttctgtgctatcaactgaagaccacccacccaaagctattagtatacaatatgatgtgtaacagagctccatgacttctctgtggaataaattatttcactgtagtttttaaaaatatttttcatgtttatactcagagtaaatgagcaatgttacaactattcttctctgtaaattgtcacaccttaagttccttaggatggctcaactctttcacatttccagcatgggaaataattgtttaataaaaataaaacataacaatggattcatgatccaaagaaggcaaaatagaagatttcttgttttctatttctcttgactcctcagctaattgtaccaccactaaacctttctttatctcccctacctcacagggttaatctctaatgctgttcaacattttatacctatgtggaaactaccatttaactaaattttgtttgatgtggaaaaaaaatcattctttcaatatttgataattttggatagctaagcacttttgttagatttttattttcttcaagagaaataaaatagatgcagtggaaaggattacttctcagtccccaggggttgaacactcacccgaggactcagtgcatttgattcctgacacttatttaagtccccttttcatgcttacttactaggacttcttaaatttgtctccttccaggtgaaataattcaaaacaactcaagaatggaactactgattcattaataaagaacagaaaataaacaagggcaaaacttgagaacataaatacacaaaaacacaaagactcacttaatttttatctcagataaaaaaggaaagtagtttgctgaatttgcctttctactaagaagtctttgctttcacttggttgggagggtacttaacatgaagaagcaggaattcctggaaaacaggccccttctaccctaatgtgttttctgtggggtcattcagttattgtccctaagcagaggtaactgggaaatagccttgggctgtaattttcccattttaccttaagcaatatcataactagcaaagtgtgacacccaggaggtttgttttctagataacactctctttacaatataagggctctttgagagagttaatataataaatcctcagagtaaagtctaggatactctttagaaattaaatattacttgaaacatatgaaagccattcagcaggtgacagagctatttacaaatagattaaacatctttcaagtaaattattataacattcattaatgttgttagtgtttatgcactaaaacatagcccaaaataacatattttatcctcatattgtagcacaatttatgttacacttgaacaaaaatccctcaatgtgcagctgattttaaatccatcatcagttctactagtcaaaagtggagaatctttttgcatttgtacctctggtagccaaagtaatgtatcttctctccatgtttctttatccattcattaatgtgctgttttcacattgcttcgttttgaaattgtccatggcccagctgaaccaagcagaaagatttcccagtctggttgcattgtatttcaccttctgttgtcaattcctttggtctcctaagaataaaatcctttggtctcataagaataaaatgagttttgttttcctttgagcatgtagaatatttttggttattgttcaaaagtgaagccacaaatcagaaaatgtttttcttcttcgtttatttgctcctctagcaatgtatatttcatatatgtgagcgcttaggtctaaatttcaggtctacattcggcacagcatcttcatggacagctaatgagattgcagatggtaaagcagaacatgtgtggtcctgggataaactactccaaatatcttattaaacccttaaccctcccctctctcacaggcctcctttgcataaacattttatattacatttttataaagacatagatgaatacctccactgtaatttttcttaaaatttagcacgattatctcctttgaagaatagaatggtcctttaatcaaccaattaaaattgtataacccaccagaagaattcatatattatgtttaataattagtcacaaaccatatgtctgggactatttaatattgactttagctccatgtatattatttccatctacttttttattttagtaggttaatagtatgagtatgaatatattaatttctaaatggaaagagatgtactttattaagctttggattgtcaaggagagcaatggttaaatatgactaaggtccatttatatttaactctgctatttttttctggaattgacagtataggtgaatgcatgctcgtattgtactttctcctttgaaataatgaagaagccagacaaaaggattattgctcacagaagagaatagaaaaaaggaagagaaccagggaaagaaggacccaatccactttctctaaaattattcatgtttgagacaatgactgatttcatgagtatcttcttacctctctatgtctttttatggcatattttaaggttgatttttgaactgcctttataaatgttttctaaggtttcaatgaaggtaaatatgcctttgcaaactatttctcaggctatgaaccatgagtgtgtgggtcagtgagtggcaatgatgacatgccacacttgtggagaaataaatgatgaaaggttaaatgctttttgccttagatcaggaagaagaggttgttcacttgtttagaatgaactctctgagtttctttatctgctcagcttgtagccattgtttctgcagccaccagagacccagacagaagcacagcagcaggagatccacttgcatgggtcagattgcagatgtggcttcaatgacatgaccacagtgtgaaagttccctggagggcacacagcatgcttagaaaacacacacacacacacggaggtcattgcctttattgggtccagggcattatataaacagggagctttaaattgatgggcttaaagcaagcaggcactagtactaggaagtcacattgtgactgaaaagtgtttaaatggtcgtttagaggaagcagcaggaaagctgggagcccatcctgctaggagacagagatgcctccaggtttttatttctggtcaccacctggagccatttgggggtatagtgcaggaaactgcatcaagggtgactgaaccctgcttctggtttgagaaagttaaacacatatttaaaaatggatgctaaggcaacataaaactttaagcgctcactgcagcacatttacctcttttatttaccattgtattggaggttctagccaagataagataattaaacgaataataaagtaaagtcattcagattggaaaggaagaggtaaaattagctctacttgcagatgacattacctttatatagaaaaccccaacaatgccactaaaaaaaattattggaactaataaacaagttcagcctgacggcaaggtacaagatcaatatacaaaaattgtaggggcccggccctgcacagcgccctggggaagctggtttgaaagctctggagcgaccccagtgccgggtaaaggacaagatttgcccagacagaagggaacttggggagaggtggccgtaagagtgtgggatgaaaatgttttgggcagagcggtcgaactcacctgaggaaagcatggggggaggagtcattaatatgaatgagtggcagggacagggcgtccttgcagcgccctcggtgttggaagggaagaccgtgcagcgcgatggggatcagggcggcgggccgcagccggggtggggttgggcgccggtcagggtgccttgaagcagattctgtcctcaggagctgcagttcttcctcctccgccctcaccggcgggcgaccttaggcagggagtgaaatgcaacgggagccctggagggagggtgaagccgcgcgtgcaagaggaacctcctattggcgagttcaggtcccccagctgcggaggtgggggaccctgtgtggcagcctgctgagcggctgcttgctccgcggttggaggggggaagctctagcccccctcctctttttcagccgagaaaccgctagttacccccttatgcaaccaagactgtaataaccctgtcacctttcacggccctccgggtctgcgcctatcctctgaagattcactcatccaccccgaggcctgttttcctcacctgttgtccctctggcagaacctaggcccctcggagaccagccagaatctatctgcccgctgttcccacccaccacactccctccccagttctatcccagctccttaaactgttggagttcaaacctcagaccatgacagcacacaggcctggactccggtatggccctggacaagttccttaatctctctgagcctcagctttcttccacgtgaagcagcggtaacattgttattaggagcctcccggccccagcacaccgacatacatacaactggatatccatcctgcctgtgaggagtcgtctttactttgggttgtttcttgtccacagaggtccacactttattttcctggaggcaccagcggagtcactgatgcacccctgcatccagcatgtttaagggagacagcctggggagggcaggaagagcctagagggtcccctagtgattagggctgtgatggggatgttactggaaaagggtccctatccagaccctaagagagggttcttggacctcctgcaagaaggaatttggggcaagtccataaagtgaaagcaagcttattaagaaaataaaggaatgaaagaatggttactccataggcagagcagcggcaggagctgctcgactgactatacttacagttatttcttgatcatatgctaaacaaagcgtggattattcatgagttttccgggaaaggggtgggcaattcctgcaactgagggttcctaccctttttagaccctatagggtaacttcctgatgttgccatggcatttgtagactgtcctggcactggcaggagtgtcatttagcatggaaatacattataattagcatataatgagcagtgaggatgaccagaggtcactttcgtcaccatcttggttttggctggctcctttactgcatcctgttttatcagcaaggtctttgtgacctgtatcttgtgcggactttctatctcatcctgacttagaatgcctaagctagtgggaatgcagcctcacaggtctcagccttattttacccagcccctattcaagatggaatcactctggttcgatcacctctgacaggggcagtgtacattcacatcttggcctttgctgcctcatccttccagatctttcagatgcttgccctctggcattctaggataggaagactgcttccaaagtgacgcaggatttttctcggacacttttccaactgcagacttctggctgacgatgcccctgcccatgcctagctctgccccaggcaggaggtgccctgcccacttgggcttgcactctggtggggatcctgcagccaccgagactgcatgctcagccccagtaggagggggtgtgtgatcaagtgagtgcctcatcttgccagcaactccaagtgctggcgcaggagcgggctccctttggggcctgcagctggatcaggcctgtcggaagtgactccgggggtgaactctggcatgcagatgaagggaacttggtggcacccaaacaggaaagcactcgactctgaagccccagaggggatgttacagccatgctaacagctcttttagtcccaccgtcagcagcctgacaaacgggcatgttaacaatgaatggggggtgtgttaacaactctgtcagtcctgttgcctgctcctgctggaggctccctggctggcctggccctgcactgcctctcatggcaaggggctgccactgggcacaggtagtgggggaggggtggagggctatggtgttactgccttcttcgtaccctttgctgacaatggaagggtgaaaagggcagagaagagttttatgaagcaatgaaacagctctcagcggagaggggatgcgagggtggtccctgacctgaagtcgggtggtctctctcccagcgtggctgggtccggggcttttatgggctcagaagtggggactgcatgctgattggtttacgagtatacaaaaaaggctaaaacaaaggaaccattcaaaggtggcatgacagtgtagaaaaccacctagggaagggtagatatatgtaaagtaagtgaagggtggggatcagtcagaggaaagtgcaccaacaggaagagatgttctcagctcagtccatggatttatccaagacttgtagcttagctttcgggctttaaactgccttcggtttgaaagttggatttcgttggggacatgccactatctgcctaggggcttgtctgactcctgccactattaaaagtactaaatcagtgcatctagcctgagggctgcccctcgtccacccagcagaggtttttgttttgttttgtttttcttttgttttaattaaaattttaattaaaagggactaatatagagggtttttaaaaaattaccatatgtgttgagtatttatgctatgccaagcactttgcatatattttctcatttaatcctctaaatagcgaggttgattgccttatctccatcctatagatgagaaagctgagactgagagaaattaagaaacccacatgaggtcatgttgtatgtaagttagtttttgctgcatcataaaccacccgtttatgatttcaaacaggtaatacttgtttctcaataactggatgggggctggatggctaaggggcctcatattttagggacaggaggagctcatcgtcagctgggtgatgggaatgtgaccacaagtctcattatccaggagagcttgaacataggggttgagtttcaaaagcagcataagggcagcaacacaagaacttcccatgtctcacttatgtcatatttgctattctcccattggccaaagcaggtcacaagggcatggccagccggtatggaaggggacaaccaaaggggtagacacagggagtgagaattgctgccattttccccaacaaagaatctaccatccatagcttctaagtgtacagctggaaatcaaaactaagtttgtcttacttgaaagttcaaaactgtcttggagctactgcccggggtctaggaatccagaacattccacacattgcctaagtcaacaacctgttgcgcacacacaccagcaactgttttacaaaagtatgtggatctggttgtcattgataaaatgcaaattaatttagatgtattattcaattcatagtataattttgttgtattttcaaatcaacagatatttacatcatttcaaagcagctcttcacaaattattcattagttacaaaaggaagtcacttcacagtggaaaaatctggcaggcgccaccttaatcaagtaaccaaaatgaacatcctcagtaataggacaaattgcaatcgtgtgcctcctgatagtctagcaagaagaacacagcatcacttctatgatgctcctgccaataatacataattggaatctaatcctaaagcaacaaattcaaattaaggaaaattctacaaaataattggcctgtaatagaagtgtaaagtcatgaaagttaaggaaagactgaagaactgttccagactgaagatgaaagagacgtgagaaataagtgcagtggtgattctgaactggatcctgacttggcaaaacttgaatagatctgttggttggatggtagaaatctattaatgttgatttcctgattttgctagctatattacaattttattgcattcagtccttgtttatagaagacatacagtatgtaggggttatagggagtcaggtcaggaactttcaaatcatttagcaaaacaaaagttctttgtactttaattccaagacttctataaatttgagattattttaaaaatacttaaaaaaaaactcctttaaagtctctcaacatgctgtcctattaatagatttctaaatttgtttttatttttatcaaggttttgtgtgcccatagtttgaagtattaaatctttttttatttattaaaatattttttaatgtccattcagaggtaatgaagtgttaggttttttttttttgttttgttttgttttttttttttttgagacagagtctcgctctgtcacccaggctggaatgcaatggtgcaatctcggctcactgcatcctctgtctcccaggttcaagcaattctcctgcctcagccacccgagtagctgtgattacaggcgcccgccattgtgcccagctaatttttgtatttttagtagagacagggtttcaccatgttagtcaggctggtctcgaacccctgacctcaggtgatccacccgctttggcctcccaaagtgctgggattacaggtgtgagccactttgcctggcttgaagtgttagttttatcttttttttttaaagaaaagtagttcccttatctccactttccccctttcctgcacctcagaggcaactgctttcagctgattactttgacaggtatgaccttatttccacgtaattgcttatgtcattatttttttctttttgaggtagggtcttgctctgttgcccaggagtgcagtggcgcacttgtagctcactacaaccttgaactcctgggctcaaatgatcctctggcctcagtctcctgataagctgggactacaggtacatgctaccatgcctggctaatttattttcgcagagacaaggtctcactatgttgcttgggctgacctctaacttctaggctcaagtgatcctcccgcctcggcctcccaaagtgttggaatacaggtgttgaaatcaagtttagcctaaagccgcctccttatatatttaagtttggcctaaaagtttgtctgtatattgtgacaagtggaggtgtaaacagactacacttgtgccaatcactgagttttggccaatcaaatgtagccaactgttcaaaccatgttcagataaggcaaatgccaagctgcagccaaacccagctgtttctgtacctcacttccattttctgtccataaaccttccaccgcatgactgtgctggagtgtccgagcctactctgcctgggaaggctgcccgattcttgaactgtttgttgctcaattaaactcctttaaattaaaaaaaaaattgtatttctctactctagcaatgaacacttcaaattaagacaattccattgataattgcatcaaaaaagaaaatgcttagaaattaattattcaaaaagagcaaaagttataccctaaaactacaaaacatacttgaaagaaggtaaaaaaaaaaaggagtaaataaatgacaagacaccaatgttcagagattgggagacattattaagatggctttccaaattgatatacagtcaccatgtctctatagaaatctcaacagccttttctgtggaaattgacaagcccatccaaaaattcatgtggaaatgcaagggactcctgatagtcaaagtaatctcaaaagtgaagagcaaatatggagtatgcacacttctctatttcaaaatttactacaaagctatagtaataattacagacttgtactggcataaggatacacatatagaccaatgggatacagctaagagtctagaaatcaatgtttacattaatagttgattttcaaccagaatgccaaggctgttcaatggaaataatagtcttttcaacaaatggtgttgggaaaactggatgtcacatgctaacgactgaaactggaccctttcttcatattttatacaaaaagttacctcaaaaatatatactaaaatttaatagataaaattataaaactcttagaagagagcataggggaaaaaaatcttcttgactttagctttcttagatatgacaccaaaagcacaagcaacaaaagaagaaaatagataagttggacttcctataatttatacatatatgaatatatcacattgtatcccataaatacacacagtcattatttgtcaattgaatttttttttaaagaaaaaaaaaattttttttgaggtggagtcttactctgtcacccgggctagagtgcagtggtgtgatcttggctctctgcaatctctgcctcctgggttcaagcaattctcgtgcctcagcctccccagtagctgggattacaggtatgcgccaccacaccaggttaatttttgtatttttagtagagacggggtttcgccatgttggccaggcttgtcttgaacccctgacatcaggtgatctgcccacctcggcccccctaaatgctaggattacaggcctcagccactgtgcctggccagaatttttgtagttccaaagatgctaccaagaaactgaaaagacgacacacagaatgagagaaaatatttgcaaatcatatatctgataagatattatatccagaatgtataaagaacacttaccactcaataataaaaagacaaataacctagtttaaaaatgagcaataaatgtgactaaagatttttccaaagattggcctgtgtgctcataggaagatgatcaacattatttgtcattagaacaatataaatcaaaaccacaaaaaaggctgggcatggtggctcacacctgtaatcccagcactttgggaggctgagatgggcagatcacttgaggtcaggagttcgagacaagtctggccaacatggcaaaaccctgtctctactaaaaatactagctaaaaattagctagctaaaaaattagctagctaaaaattagctaggcatggtggtaggtgcctgtaatcccaggtacttgggaggctgaattttacttttagatggataaaatgtacattatataaactatatgtcaatacagctatgtatttttttaaagtacaaactatttttttaaatacaaaaacattacatagcgtgaactccatggcacagctgccatactgaaggaattatactgtgtttaaaaacctgattaaaaattaagtttttaaaaaatggggtcattaaattttattttaaggttttaacagttctttacccaagccaaacattttatctacagttgcccaaggaaatgcagtaagcgggttacttaatttcctccctgtggcaatccttggctctcgcccttcttaacactttattaatgcaagtcagcaactgctagttttacatcttatctttcatcaatgtttaagagatagcaagtctagggctcattatgatctgctaatatagttcttaacaagacacttagcttccatagttatttgccaatgaagcaagaaagtggtaccacttcatcattattctgattttattggagagagtgaatgtgtgagtttactgagggaagcagcccaaggaagtgggatgggacaaattctacaacagagatcacccatagacaaggagtggacccatgaaacttaaagacgtagcgatttagggagtgactttacatcctaggattaatgtctttgggggtttatgattaatatttagttccttgttgccatgtaacagaagatgtaaatgggttgctgtggtgagtcatattataattttggttttttttttttgagacggagtcttgctctgtctcctatgctaaagtgcagcggcgtgattttggctcactgcaacctccgcctccctggttcaagtgattctcttgcctcagcctcccgagtagctgggactacaggtgcccaccaccacgcccagctaatttttgtatttttggtagagacagggtttcaccatattggccaggctggtcttgaactcctgacctcgtgatctgcccgcctcggcctcccaaagtgccgggattacaggcgtgagtcaccgcgcccagccaattttggttttaattagaaactagataggatgcataccaaatatatattatgacgtgtccccaccccctgccaaatagacacatatacattgtctccttatcttttctccaatcacagtatctatttcactcacaacttttatgcaaaatcatgaaataaaaataattttaaaaattattaatcttcaaaatcttaaaaattattaatcaaatggataaatttgatatatgtgatattatttgtctttggtaattttgtaaagacttttaaactgtttttaacattcaaaaggaaagacacatctctctcttttaatgtagaaagtcagtcttggttatttacagcatacatggggggccttatctgattctccaatccctggaaaaatagagttgaatgctcatttgatcctattccacatgctactggtttccctcctgttcaccctgctccagccttgaggatgttcttgttgaaatatcaccatccaaagctcttcctctatcaggcttttgcatttgctgttcccttttccacatcttctcaaggctggatcttctttagttttcagcaaaatgtgaactctgtgaagaggcctccctgaccactcaattagccactgccccatgactagttttttttttttaacttccttaaagtgctttaacttcctcaagcccttattattattctttgagtgcattttgattatttgtttcttgtttatcatctagaagtagatgacaacttcatgacaacaggaacataatcctcatgagggcaggcattttactagtattgttcacgattactctcccactcccatgtcaaattctgtgctgtaataggcattcaataaataatggaatgaatgaacgacagacaaatgtcacacatcatgccacctgatgttataacatccaatgttgataaccgaacagaagcaaaattaaaggccatgagatattggaatggtcacactgattaaaggctttgtgggctacacctcattgcacacatttatcaatgactgaattaaggtgatatttagcagtttgatattacctatgaaaacaaaccaaatggatgtagcatgctttctttttttgaaacatatttaataattgatttcaatcattttcaatctgaattttaatatacttttaacaacagatttcatagtttggtcttgtttttcttgtttgtttagtgactcgtttacttgagcattaatattaagccagttctttgtgtagttatatgtagaagtagccatcaactcccaagcaccaactccaggccagttcaaatacggaagactcacttgaattcctgcatctcaatgatggtacagcctggagcccttctgtcctccataccaacaggcatttacagctgatttggttgtttggcagcgaatctctgtcctgctgccttcaagctgccatttcatttcttcaatatggagacaggaaatgtggcttaccatcagcaacaagctagtagtaatcatcctcatggaagacacaaaaacgtttgtcaagagggtccaaagtttgtagctggtgagaatgtacaggaaagaaggaaggaaggaagagagggagggagggtggaagagacagagggagggtggaagaaagggaggaaggaaggaaagagggagggagtaagagagtaagagagagagtctgagaaagatagaggtggactccacacataccagcaaaacaaactcatgaggtagaactttttagcatttaagctttgaccagcatccagatgattttcttttcttttctttttttttttttgagacacagtcttgggccatctcccaggctggagtgcaatggcacgatcttggctcactgcaaccccctcctcctgggttcaagcgattctcctgcctcagcctcccaagtagctgggattacaggtgcctgccaccaagcctggccaccacgccatcacttctccatgttggccagcctggtctcgaactcctgacctcagtttatccaccctcctcagccttccaaagtgctgggattacaggcgtgagccaccgcacccggcctcaaatgattttcaaatgtactcagcaatgcaaaactatcatcccgaattcttaatttggtgcattttgcttaaaggaatgtaagttgacaaatggtatgtgtaatttcccctgtggtttccctcttcagagtctgtgctccctgcattgaataatgagatgtaagtttaggaaatgcctccatggtgttcattatactttgtgtattttccctgagacaggaaacagaggactgtctgtcaaagaaagtaatttttataaattcacagccaacggggaatattcctttcattttttttagctaaatctgtgatttaacaaatgtagtgtttgtcagcaaggagattgaaaccattatgtctttctctacctgttgataatgatattgcaagtgggaagtcgcaaatatattggcatcaatagcaacacggcaagcagatgaagctccaaaactcatcacccactttgaagccaaataaaaagcccatttttctttctagttattaatgatgtgaaactacagactgtaactgcaaataatcattggcaagggcaacataaaagttataaatttaggctttgaaaacaaatcaaacttgaaggaatcctctgtaatttattcctaaattaaagatttcctctttttttttttgagtgaaagaacttatacgtaagcatggaaatgagaactaaatcatttgctgaaacaattgtctgagagttacttaattcaaaaccactcttgtctatgaaataaagcagaacttgattagcacgtaataaaaggcaattaatttaacagacagtaaatatattgctgattcctgaagtctctggccccattttctcttcagaaaactatttcaactgatagcattctctcctttcattgaagtcctatagtaattaaaatcagttatttaattatatactgccttgatatacagagttcagactttgtaggactattgctaatcatctaaatcaggagtttggtaaactatggcccaaagaattaaacttggccataaccatttttttttctttttttttttttgagatggagtcttgctctgttgcccaggctggagtgcagtggcgctatctgggctcactgcaagctccgcctcccaggttcacaccattctcctgcctcagcctccagagtagctgagactacaggcgcccgccaccacgcctggctaattcttttgtatttttagcagagacagtgtttcaccatgttagccaggatggtctcgatctcctgacctcgtgatccacccaccctggcctcccaaagtgctgggattacaggcgtgagccactgctcccggcccttggccatacccatttttttacattttatctatgattgctttcctgtgattgagttgaacagctgtacagagacattacagcctctagaacaaaagtaaatttactatctggccctttgttgaaatagaccttaagattgtcacgggaaaaaattgaatctcctactcagaggatattgtttcacaagtgcggtccctaaaatggagcagggaaccctcttggggcctgcaccccctccattccaccaccctgcacccccatgcatggaaataaaggaaaatattgagttccttcaagggaaattccaggcacctagctaaccctgagaagcaagcaacttgataagcaagaaagtaatcacagcttaaaacaacagccaaggaagttctagccataagatatttgaaactaaaggcaacattttaacatatgtccctgagttgtttttcagaaacccagactccctaccgagcagatccgctggcgggtagaacacagataagggggagctgaggactgaaccccgaactccgtttgtccttggctctaaatttattcttgagggacctggaggaagccgtgcccacgtgccagagctaataatcttttctgctgaccccaaatgtttaaacaaactcttttttcatcaattgcaaaacagtctttgaatataccaatgaccggtaatcttctacttcaaactatcccacctttttaggccaaaccaatgtatcagttcacaattttgttgtaacttctgttttcctgaaatttacccctgcctttaaaacccttacttgtggccgggcgcagtggctgacgcctgtaatcccagcactttgggaggccgaggtgggcggatcacgaggtcagaagatcgagaccatcctggctaacacggtgaaacctcgtctctactaaaaatacaaaaaattagctgggcgtggtggcgggcgcctgtagtcccagctactcgggaggctgaggcaggagaatggcgtgaacccgggaggcggagcttacagtgagcggagatcgcgccactgcactccagtctgggtggcagagccagactccatctcaaacaaaacaaaacaaaacaaactcttactcgcaagccatcaggaggtcaggtgtaaagcaggagctgctatattctccttgcttggcaccctgcaaataaacacctcttttctcctgctgcaaaccttggtgtgggtgtttggcctgactgcgctgggcaggcagacccagcttaggagtgaaaacatcccagaccagcagcatgagcaccacctagcaagttgtcagaaatataaattccaggctgggcagagtggctcacacctgtaatcctagcactttgggaggccgaagctggtggatcacctgaggtcaggaagtcaagaccagcctggccaacatgatgaaaccccgtctctgctaaaaaaatacaaaaattagccagggtggtggcgggctcctgtaatcccagctacaagggagactgaggcaggagaatcgcttcaacccaggaggtggaggttgcagtgagcccctgagatcatgccattgtgctgcagcttcagcaacaagagcgaaattttgtctcaaaaaaaaaagaaaaaaagaaaaaaagaagactgaccatgttgagaggtgaagccagctgggcttctggggcaggtggggacttggagaacttttatgtctagctaaaggattgcaaatgcaccaatcagcactctgtaaaatggaccaatcagcaggatgtgggcagggccaaataagggactaaaagctggccacccaagctagcgtcagcaactcgcttgggtttccatccaggctgtggaagctttgttcttttgctccccacagtaaatcttgctgctgctcactctttgggtccgccccacctttaagagctgtagcactcgccacgaaagtctgtggcttcactcctgaagtccgtgagatcacgagcccatgggaaggaggaaactcctgacacaccatctttaagggctgtaacactcacggcgaggttggctgcttcattcttgaagtcagcaagacgaagaacccaccacaaggaataaattccggacacaatgttacctgtcatttaaaatgtagccacttctcctccctttcctggtctctccttgttcctattggaagttacctctaacacttccatttgtttaatatcataaagttgcaagaaacgtacagagagagaaaaaggttctaacttttcttaagataatatgggtgtatatatacgcaaatatatatataatgcttgtataaattaacatttattatcttctatgatatgataaggcatatcaccaagtaatctggaatatcaaaatatcagcatcagctctctctgtttcaatacgtataaactaggtagttcactaggaactttgaatacattagctctgacctttacaacagttctatggaaaaaaaatagttatctccttttaacagaggaagaaaattgatttttcagggtatttccactcttacctcagtttcctcatatgtaatgtgggattgactcagtcatctgcttgaaagaagacgggcaaatctggtcctctgaagagggaaaggggagatgagtgaaaatgaacagaggaagccaaaaaaaaaaaaaaacacacacaagcacacaccaaaaataaagaggagacccattttaacaggcatataacaagtcagttttatctctttatttttttattttgtatttttttttgagactgagtctcaccctgtcgcccaggctggagtgcagtggcacaatcttggctcactgcaacctccacctcccgggcttaaaggattcccttgactcagcctccagagtagctgggattacaagtgtgcaccaccatgcctggctaagtttttgtatttttagtagaaagggagtttcactgtgttagccaagatggtctcgatctcctgacctcgtgacccacccacctcggcctcccaaagtgctgggattacaggcatgagtcaccacccccggccgaaaccttaattttatgaaatgttttttatgttccagaccttaactgatgagcttttaaaactaacttctaaatttgaaatgtatatttaattatggaatacgctttaatgtaatcttttgggataatcacctaatattttgccttggcattaggcatggagcatttgtctgggtgatcacatggagggccctgcctcagtttacctccctcattgacctgcttgttgactaaattatcataacttgatcacaattcctttgaagctgcctgaatcaaagccactgatctgcagataaaatcaaaatacacattcagtgttacacacaaagtaacattgccttatatactgtatctacactttattgagaactggaaattccataaagatggagaggcattactgaaggcaagcaagcaaaactctagcatgcagtcagactcatggcaggaattaggcatgatctaccttgtcctcacccttggggcactgcctgcatgtctgtaggcctcggccatgcccagctcctgtggctgcctggaaagtgtgggtttggccagttgctgccatcactactcctcaataggtcctggatctcagaatttgcctggtagtcctgggcccacctgctgatgttcaggataaagggagtggggagaaggggtcattctgcttccttcacgtggaagtgcaggtgttagttttgggggactggacagcaaagagcatggttccttgactcctgggtcatggggtgtctggccacttccacatcgttgccactcactcctagtgatacaccaggcaccagaggctccactcctgaggcacatgccccggctgcctcaacactggcccttccccccaccttggatgagctcctgttgcttcagcatgagcagggctcactctttcactctgcagcaggcctaggctgtgctggcttctgagatgccccggggcacctgctgggaagtggggtgtatgtgcgtgaggcgccagtgttggtccattctcgctgggcagccttattttcccagctttttccttgtgccgccctcagccttttgtctctcatgacttccctttcaggtcacaccactttgctgcttgatccttgagtgttagcaacccttccctgctctgggactcagtttaccttttgttggtctagaggggcaggacaggtgatttcttcccagcttgactccagatcaatagcttgccctcccctggtgacagcagagagatctgtgaatcactgcccaccctcacccccactcctgcccctcggcatactccccgccccaggtcttcccaggtcacctgctcttaggctccaccacacccctgcaggtcagcctctcccagcagccttcccgtagactccttctcctctctccccctctctttcctgtagaggctttggagcccatcagcccgaggaccaggactccaccgccctgcacccctcttgcgccaggatggccccaaacttcggcagatgctctggctctaaaacttggaccagcaccaggtaccccaggcagggccctagttctgctgtcctgccctgaaggccatgttcggtggctggcctagcctgatgggaacatgtacagtcaggaaatctctccacagctccaggcccaggtaaatggttctcaatactctggtccaagggactggtcctttgaggtcaggagcacatctcagcttcaaggaaagctgaaaaacatgcaagactctattgccaggagaatttatttttattttttctttgtgttattattattttttctttatctgccttttttttcttttttttgttttgtgatggagcccaggcgggagtgcaggggcatgatcttggctcactgcaacctccgcctcctgggttcaagtgattctcttgcctcagcctccccaggtagctgagactacaggcgtgtgccaccaagcccaattaatttttttttctttttttttttttagcaaagatggggtttcaccatgttggccaggctggtctcaaactcttgacctcaggtgacctgcctgccttggcctcccaaagtgctgggattacaggtgtgagccacctcacctggccctgggccaataattttttaataactcctaccataatatttttgtttgttatttatttgataaatatgatagactaaaaataaattagcaaggccgggtgcggtggctcacgcctgtaatcccagcactttgggaggccaaggcaggcagatcacctgaggtcaggagtttgagaccagcttggccaacagggtactaaaaatacaaaaattagccaggcgtggtggcaggtgcctgtaatcccggctacttgggaagctgaggcaggggaatcacttgaacccgggaggcggttctgtttgcaagtatagttgtaactgcaacccaaaatgtcttagaaacttgctatttgaagtattgtcatcacctgggatcttgctagaatctgcatttaacaacattctcaggcaattttaatgatcattaggtttgaaaaacactgccttaaaacaaaggaaagaatggcaggcaagtttcaattctaagcatgctatattgtatgttcttgggcaaattccactaagtctgaattttaaaacagttaactatgggtagtaatgaatgaagtgtcaccttgtaaagctactttgagaaatccaagtgttggcaaaccctttgcaaaaataaagttgctgaacatattctaatacagttatgttgggctcctgttcttatgaggcagagaaaattatgctttaatcagagcttctaagtcacaatcactggaatctattattagcctttaagtcctcattcttgagacagcaccatgtctattcttggttgctgggaaactgattatgctcttcaaatagaaactgcagcagcagatgaactttaagaaaatataatcatgtttgtaagaagaaaaatttaataaaggaagaaatgaagcaaaggaaactcataaactgatctgttttgaaattccatttctgccctcatgatagcattattgacttaataatgaagcaatgttactcattcacaattgtacagcaatggccaaagactgaatgacctctattttctgaaattgtttcattcacagagttcactcctgatgggaacatccagagacatcttcagagagctttgctttgacccccaccccccaacattttaaggcatggatctggaaataatgtagttggtttacaaaggtaagtcttattttacaattgcatattccacaaaggcatttcactttcaaagctcctccaagacaattacctccagattgagacacaccctgctcctgaattcatgcctgcataccagccattcttaatcaccttcctttttaatccagttggaaaataaaatgtttccttgttctctgaatgtacagtactcagatgtacagtgaaaatgattgatgctcaaaccgcctataaattctttgattccatcagcttttctctttctactggccatttcccattagtgtttaaacttaagactcacacatctcccatcaaataaacccccttcaccctacttcaccgatttcagtattttagcttctcctctccttatttacttcccatttgtctttcagtccatcctgctctattttcacttctacaattgcacagaaatgtctctgataaaagttcccagcatacattttggaactgatattacttgatctcacttcatggtaacaatatgctgctgatggaagtaccacagaactcacaaaaagcttttacttctccagggaatttcatcatgtctgtctagacccaacaaagccaaaccctgaacaatggccatttcagcctccatttgacccaagccaacttatattgaataaactaatgctttaaaaattataatgagccaggcatggtggctcatgcctgtaatcccagcattttaggaggccgaggcgggtggatctctagaggtcaggagttcaagaccagcctggccaacatggtgaaactgtatctctactaaaaatacaaaaattagctgggcgtggtggcacccacctgtaatcccagctagtcgagaggctgaggtgggaaaatcgcttgaacccgggaggcagaggttgcagtgagctgagatcacaccactgcactccagtctgagtgacagagcaagactgtctccaaaaataataataaataaataatgaaattcaattgataatgatggaaatcaaccaataaacctacaatactttaagattctttttaaaagaaaacaatatatttttattagaaaaagtaaaggatttattcataataagtaaatcttggtttcagagctcttaatttactgattgactgtgatcagatgccagtgggaatgtgtctgtagcaccattactcacatgagggagtattttaaccctttatatatacatcactaatagtggaaccttgaagaagtccatttctcaatattgatataaattataatttatattgacacactagttttttttcccataagttttatattgaatccaagaaagctttatcagtgtctgacaccaagaaatatgctttaaccgtaatgtatttggaatgtccacagtatattccacggtgtgtgaatctttagctttagaaattagctttgacaagggagaggtcctgaattatccaacaacaaaattgaattattgtataagatgtagcgcccatacctgcagggcatgtgaagctcagtgattggataataagacttttactaatgttatggaacctgggataagcattgcgatagaaccaggaagactgttgtagttcttttatgactcagaaacagtatgatgacttacaactaaaactttgttcatacaaggccagcactcttctaatgatgcaatatgcatttgatttatccattgttactattgtccacatgaaaagcaaaaattgacataatgtttatgatttaaataatgtaatatataattataatagtaataaaagcatatataataatgtttatattatgattacgttaggtggggtttccttcttttcccttcaaagctggataaaattgaattatatagccaataacatgccctgtgcaagtctaatactctcttgaaaagtgaaatctctcaggtaagccaaagtttcattgtcacctctggctaaaaatttctacttctagtacgtgtgagatttttttttttttttttttttttgagactgagtcttgctctatcacccaggctggagtgcagtggcatgatctcggctcactgcaacctccacctcccgggttcaagcgatttttgtgcttcagcctcccaagtagctgggattatgggcgccagctaccatgcccagctaatttttgtatttttagtagagatggggtttcaccatgttggccaggctggtctcaaactcctgacctcaagtgatctgccccactcccccaccgaaaatgctgggattacaggtgtgagtcactgtgcctggctgaggattccttttttaaaagtttctacagtgttggaaaataatcaggagagtcaggcaatgtgaaggaactactcagatgtcactggccatctggttaagaagcacagtgatgccatcttgttctaggatggcggcagtagggatggagagaacgttgaggagccattctaattcttcccattaccgtgttttatttttgtaatagcaatgatcactttctgcaattatattatttctgtgtatgtttgggtattttttatttatctactttattttcatcttccaccatgaaaatataagatcgaaatggcagagtaaagatgtgctttgtcttgtacactatatcaacagaactttgacattgctgacagacagttgatgcacattaaatatttgatgaataagtggatgaattaatgaatggaaatagagcaatagggttcgctctagggtagtgtggtatcatgcaagtgggtgtgtaaattgggagagacctgagcatgtttaaatatactggggaattatgtggttggaacaataaattaaatattgagatactcaagcaagatgtcatgggacctaatacaggagataagactatgtgattcgcattaaacactcatgtagcatgtttatacgagatcttcagacttgctatataattattcagcactcaaggtggtgcttaggaaaattgaggaactaaagactcctttgtgttacctgatctgtagaaataatttaaaaccttgtctagttttctttttttttctcctgtcataagcttgttaagagattcctccatagaaactttttttggtaaaataataactgctgttcagtgcatcatttctaacaatgtgatgttagctacaaatatttaggtagcacatcccttcaaaataggcgcttgtggcctgggcgcagtggctcacgcctgcaatcccagcactttgggaggccgaggcaggcggatcacaaggtcaggagatggagaccatcctggctaacacggtgaaaccccgtctctactaaaaatacaaaaaatttgccgggcggggtgtcgggcgggcgcctgtagtcccagctactccggaggctgaggcaggagaatggcgtgaacccaggaggcggagcttgcagtgaaccgagattgcgccactgcactccagcctgggggacagagcgagactccgactcaacaacaacaacaacaaaaaataggtgcttgcgataacttggagtgctgttcttactgatgctttcactttggtagctcacctctcctacgggaactgtgttctcagacatgtcatggggagtatgtcatcagcacagcttcattggtagagtttactaaaaatacaagttatctgtattttccttataaaggccttcgtatagcgtccaatattttctaaccagatgtacagtgaaaatgattgatgcttaaatacattttcatggtcaatgcaacaaccgttgagcaaaaaaattaacatttattgcagacactaggcagttgtcaaacaatattaatgtcattaaatcaataaatgggcacagaataatggaagcaaggtcatggatgaacagatggcagtgtaatggagtcaatcttttactgatttaaccactctcctcttatttctaatgtcccttccatcacgatgagttctctttgggatgatgtgtatctaactgaagctcctcctcaacagctgctgagaattgagtgttggtggtaattatccatatgatttttaatcagacacttttcacagattcaagtggaatgataactctatgggaaattgataggacagccagagttatgcaaattttggaaaaaaaattaatcaacagctaatacaaatattatgtctaaaggctaacaactggatgatcataataactcaatggctaataaataaactagggaaatccaagccagaattagaagtaaaaattggccattatataattatgaccaagaagttctttcttagttaacaaggggtacagctgtatgtttatttcaaagtaatttttttgtctgcagttacaatgttgaatgaaaggctaaaacaattccttccttagccctttccctttgatgtgaaaaattaactctcagtaccctcagtaactttgaatatgctttttatacccttaaagacaaaaataaagtcatcattttttcattgactgtaactattaatactatattcatgttactgtagctttaactgatgactcatttttagaacatattatcattgatctatggcaaatgcttttaaaattcctcagaagctaatcatttatgttgaaaactcacaaaactgcacataatataatagataaagggagggcataatgaagttttcatttgacttatctgggttttgggatttacccccttacagtatgtgagcctatgaataagtaggtgagcttccagtgctcaaaggtttaatgtacagtgtatttatttttaatctttgtgaattttctatagagcagagctgtttccagtgaattaaaccatatttacttctactacaatattgtagaatgtaattgttacctttactatatatatatattttttcttttttatttatttatttatttatttatttatttattttgaaaatgaatcttgctcggtcacccaggctagagtgcagtggtgtgatctcggctcactgcaaactccacctcccgggttcaagcaattctcctgcctcagcctccaagtagctgagattacaggcacatgcaaccatgccaactaattttgtatttttagtagagatggggtttcgtcatgttggccaggctggtatcaaactcttgacctcaggtgatccacctgcttcggcctcccaaagtgctgggattacagacatgagccacctcacctggccccctttactatatttaaagatgacattgtcatgtgatgtgtatgatgaaaagtatatcattgaactctattctcatatgaaagaacatctgattttctagaagatttatctgccccaggtatattcctgtgagaataatacaaaccaaattaaaatgaagtctgcttttttttttctattccttattgagattgaattcagaattccaaacaggtttgctattcattttcatcctgacaaaatcaaaacctaaatattctatgtgtcacctactgtgatgggaaagataaaactaattatttaattatcaaacatgagtaggtgaattatttttattaatcaacattacataaacgtgttttgagaataaaattttttatcctcattttttaaccaaagacataaaatataactgacattctgtagccaaatcaatgatatatacacccagattgacctttaagagtttaaaaataaatgtacgctgcatggtcaaatggatttggagatacataggctagtagatgaagcactagggctttatgaaaccttttttgagggccggtgctgtggctcaagcctataatcccagcagtttgggaggcccaagcaggcagaccacttgaggtgagaagttcgagactagcttggccaacgtggcaaaacatctttactaaaaatacaaaattagccaggcatggtggtgcacacctgtcatcccagctatttgggaggctgaggcatgagaatcacttgaacacgggaagtggagactgcagtcagctgagattgtgccactgcactgcagcctgggcaacagagtgatactccacctcaaaaaaaaaaaaagaaggttttttttttgagttagtgatacacgttaataaattaatccagagatttaaaaaccacttttactttccatgttaaaaaaaatcagcatactttccaactataacctaaaaatctacaaaaaactttccaaattctcagtaaaggaagtattgcaatccacaggagattattgctttgttctaaagacagttgaaacattttcgaatctctgacattttttagatcaccctttgcagggtggggttcacagaacattttttttcctgatcatatgacattgcctacataattttgtgattaaatgactttggaaaatcaggattgagacaagtaaacagtcctatcagaactaaatatgttaatgtatggcgtccccaaggggtgtgatatgcagcattaactcttaaatgtagataatcatgggactttaataagcagatacactttgtgaattactactttaaatattggtagtaatagattgcttaatcgaacttaaatttaaagagatgatgttggacttctagtgaatggaagccaagtatttctatttactagaaaaatgtacatgatctattgtccacagtgaactagcaaaccttccatcttgatatttagttttcatattaattgtattatatttcatcagcttacattttttactcactagggcatacttttatttttttcattgcaatagcttattcaatatctgcctattcatatattaagtaataattttttttaacctgcatctcacacagagaaatcatgaggaaatctccactcattctggtcagcatcacagttgcagtatgttgcaggattcctgggagtcgatatgattttttctaatacacacatatgtttctcagcattgggcaaataacctctccggtaactgtgcgcttttctggttcttcccacctaccagctcaacagggtatcatctgaaaaaagaatatgagaaaggcgagtcctatttaacccaactactcaccccctaatgcggttccgcttccgctcagataataacgtaaaaacagttttttggtgtgtgtgggttttttgttttttttgtttgtttgtttgtttgtttgggacagagtcttgctctgttgcccaggctggagtgcagtggcgtgatctcggctcactgcaagctctgcctcccgggttcacgccattctcctgcctcagcctcctcaagtagctgggactacgggcacccgccaccacgcccggctagttttttgtatttttagtagagacggggtttcaccgtgttcgccaggatggtctcgatctcctgaccttgtgatctgcccgcctcggcctcccaaagtgctgggattacaggtgcgagccactgcacctggccaaaagaaacagttttaagaaaataagtccaaaccctgcaacagaacatttctttaagaatactaaccagcttttttttttttaattaaaaaatatttacggctgggcgcggtggctcatgcctgtaataccagcactttgggaggctgaggcgggcagatcacgaggtcaggagatcaagaccatcctggccaacacggtgaaaccccgtctttactaaaaatacaaaaaaattagccgggcgtggtcgtgggctcatgtagtcccagttcacaggaggctgaggcaggagaatggtgtgaactcgggaggcggagcttacagtgaaacgagatggcgccactgcactccagcctgggggacagagcgagactctgtctcaaaaaaagataaaataaaataaagagactttaatatgttcagtaattacacaaaattaattatcttgagcaggccagttacataatttcttttgtttttgttttctctttctttctttctttctttttttttttttacacagagtcttgctttgtcacccaggctggagtgcggtggcgtgatcttggctcactgcagcctctgccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctatatgagggagaaaaactcagaacctagcagcagtgttctggaatcctatgggacggacatacatgtagaccccaccagcatgttctgggatcctatgtgagggacaaactttcagacctcgtagcagtgttctgggatcctatgtgagaaacaaacactctgaatccagcagcagtgttttgcaaacctatatgtgggagaagcattcagaccacagcaggactgttctggaatctgatgtgaggcacaagccctcagaacacaacaggagtgttttggagtcctatgtgagggacaaactttcagatccttgtagcagtgttctggtgtcctatgtgaggggcaaagattcagacaatcgttgcagggttctggaatcctatgtgagggacaaatattcagaccctcatagcagtgctcgggaatcctatgtgagggacaaaatttcggacaccagcaggagtgttctggaatcctatgttaggaacaaacactgagacagtagtaccagtgttctggaatcctatgtgagggataaaaattcagactatcaacattattctggaatgatatgtgagggacaaacattcagacccccgaagcagtgttcaggaatcctgtgtgagggacaatcactcagaaaccagcagcagtgttctggaatcctatgtgagggacaaacattctgacatcagcaggactgttctggaatccaatgtgagggagaaacactcagaacacagcaggagtgtttaggaatcctatgtgagggagaaacattcagacaatcgtagcagtgttctggaatcctgtgacagacaaacattccaaccctcgtagcagtgttcaggaatcctaagtgagggaaaaacgttgagacaatcataccagagttttggaatcctctgtcaggaacaaacattcagaacccagcaacagtgttctgcaatactatgtgagggacaaacattcaaacagcggtgggagtgttctggaatcctatgttacagacaaacattcagacccttgtcacagtgttctggaattctatgtaagggagaaatactcataacccagcagcagtgttctgtaatcttatgtgacggacatacatctagaccccagcagcagtgctcaggaatgctatgtgagggaaaaacctacagacctcagcagcagtgttctggaatcctatgtgagggacaatcattcagaccctcatagcagtgttccggaattctgtgtgagggacaaacattcagacgctcatagtagaattgtggaatcctgtgtgattaataaatattcagaccacagcagggttgttctggaatcacctgtgaggaacaaacatttagactctcatagcagtgttctggaatcctgtgtgacagacaaacatttagctcccagcagcagtgtctggaatcctatgtgagggacaaacattcaggccctcgtagtggtgttctggaaacataattgagggacaaacagtcagaccacagcaaaagtgctctggaatcctacgtgagggacaaacattcagattatcatagcagtgttctggaatcctttgtgacggacaaacattcagactctcgtaacagtgttctggaatcctatgtgacggagaaacattcagagaatcatagcagtgttctggaatcctatgtgagggaaaaatattcagataattgtagcagtgttccagaatcgtatgtgagagaaaaacattcagaacttcatagcagtgctctggaatcctatgtgagggaggaacattaagactatcgcaacagtattgtggaatgatatgtgagggacaaacattcagaccccagcagcagttttctggaatcctatgaaagggacaacattcaaacaacagcaagggtgttcatgaatcctatgttcggacaaacattccggccttcatcccagtgttctgaaattctatgtgagggagaaacactcagaacacagcagccatgctctagaaccctatgtgacggacatacatgtagaccccagcagcagtgttcagtaacactatgtgagggacaaacattcagatgccagaagcagtgttctggaatcctatgtgagggaaaatcattcaaacccatgtagcagtgatctagaattctgtgtgagggcaaatattcagaccttcgtagcagtgttctggaatcctttgtgagggacaaagattcagaacacagcaagattgttctcgaatcccttgtgaggaaaaaacatgcataccctcatagcagttttctggaatcccatgtgatggacaaacatttagaccacagcagcagtgttctggaatcctatgtgagggacaaatattcagacgctagtagcagtgttctggaatccaatgtgagggacaaacacccataatgcagcagcagtgttctcgaatgcaatgtgaaggacatacattcagaccacagcaggattgttccggaatcctatgtgagggacaaagattcagactgtcatagccatgttctggaatcctatgttagggccaaacattcagaccatagtaggagtgttctggaatcctgtgtgagggacaaacattcagatcacagcaggattcttctggaatcccctgtgatgaacaaagattcagaaccacataacagcgttctagaatcctatgtgacagacaaacatttagaacccagcagctgtgttctggaatcctaggtttgggacaaacactgagaacctaccagcagtgttctggaaccatatgagagggaccaacgttgagaccctcgttgcagtgttctggaattctatgtgagggagaaacactcagaacccagcggcagtgttctgtaatcgtatgtgagggacaaacattcagacctcagcagcagtgttctggaatgctatgtgagggaaaatcattcagaccctcatagcagtgttctgaaattctgggtgagggacaaaaattcagaccctcacagtagtgttctggaatcctgtgtgagggataaacattcacaacacaacaggagtgttctggcatcccctgtaaggaacaaacattcagaacctcgttgcagtgttctggaatcctacatgatggacaaacacttagaccccaacagcagtgttctggaatgcaatgtgagggataaacattcagaccctcccagtagtgttatgaaatcatatgtgatggaaaaacactcagaacccagcagcagtgttctggaaccctatgtgagggaaaaactttcagaccacagcaggattgttctgggatccgatgtgagggataaacactcagagcacggcaggagtgttttggaatactatgtgagggacaaacattcagaccctagttgcagtgttctggaatccaatgtgagggacaaacattcaaacaacaggggtagtgttccatgatcctatgttacagacaaacattcagaccctcgttgcagtattcaggaatcctatgttagggaaaaacattcagaccctcgtagcactgatctggaatcctatgtgagtgacagacattcagacaatcatagcagtgttctggaatcgtatgtgagggacaaacatccagaccctcataggatcattctggaatcctatgtgagggacaaacattcagacaatcgtagcagtgttctggaatactatgtgagggacaaacattcaaacaacagccagagtgttctggaatgctacgttacggagaaacattcagaccctcgtcgctgttttctggaattctatgtgagggagaaacattcagaatccagcagcagtgatctggaatcctatgtgacggccatacatgtagaccccagcaacagtgatctggaatcctatgtgacggccatacatgtagaccccagcagcagtgttcagtagtcctatgtgagggagaaacattcagaccccagcttcagtgttctgtagtcctctgtgagggacaaacattcagaccctagcagcagtgttttggaatcctacgcatgtgacaaatattcagacccttgtagcagtgttctggaatcctatgtgagggacaaacacagagaatctagaagcagtgttctataaccctatgtgagggacagacattcagaccacagcaggagtgttctggaatcctatgtgagggacaaacatttagacaatcgtagcagtgttggggaatcctatgtgagggacgaacattccaaccctcgtatcactgtttcggatcccaagtgaggggcaaacattcagaccacagcagagtgttctggaatccacagtgagggacaaactttcagaccctcgtggcagtgttctggaatcctacggaatgacaaacattcagacagtcgtagcaatgttctggaatcctgtgtgagggaaagtctttcagactcaagcatcagtgttctggaatcctatgtgagggacaaacattcaaacaacagcgggagtcttctggaatcctatgttaccgacagacattcagaccctcgtcgcagtcttctggaattctgtgcgagggaggaacacttagaatcctgcagcattgttctagaatcctatgtgacggacatacatgaagacccttgtagctgtgttctggaatcccatgtgagggacaaacattcagaacccagcagcagtgttctggagtcccatgtgagggacaatcattcagaccgtcatagcagtgttctggaattctgtgtgagggacaaacattcagacccttgtagcagtggtctggaattctgtgtgagggaaaaacattcagaacacagcaggaggtttctggaatcccctgtgaggagcaaatattcaggacctcatatcagtgttctggaatgccatgtgacggacacacctgtagaccccagcaacagtgttctggaatcctacatgagggacaatcattcagaccctcatagcagtgttctggaatcttatgtgaaggacaaacatttagacacaagcagcaatgttctggaatcctatgtttggggcaaacactgagaacctaccagcagtgttatggaaccatatgagagcgacaaacgttgttaccctcgttgcagtcttccggaattctatgtgagggagaaacactcagaacccagggacagtgttctttaatcctatgtgaggaacaaacattcagaccccagtagcagtgttctggaaaactatgtgagggaaaatcattcagaccctcacagcagtgttctggaactctgtgtgagggacaaaaattcagaccctcatagcagtgttctggaatcctgtgtgagggacaaatattcacaacaggagtgttctggaatcccctgtaaggaacaaacattcagaagctcgtggcactgttctggaatcctatgtgatggacagacatttagagcccaacagcagtgttctggaatgctatgtgagggacaaatattcagaccctcccagtagagttatgaaatcatatgtgagggaaaaacactcagaaccgagaagcattgttctggaaccctatgtgagggaaaaactttcagaccacagcaggattgtactggaatcttatgtgaggaataaacactcagagcatggcaggagtgttttggaatcctatgtgagggacaaacattcagaccctagttgcagtgttctgggatccaatgtgagggacaaacattcaaacaacaggggtagtgttccatgatcctatgttacagacaaacattcagacccttgttgcagtattcaggaatcctatattagggaaaaacattcagaccctcgtagcactgatctggaatcctatgtgagtgacagacattcagacaatcatagcagtgttctggaatcctatgtgagggacaaacatccagaccctcataggatcgttctggaatcctatgtgagggacaaacattcagacaatcgtagcagtgttctggaatactatgtgagggacaaaaactcagaccccagtagcagtgttctggaatcctatgtgagggacaaatattcaaacaactgcgagagtgttctggaatgctatgttactgagaaacattcagtccctcgtcacagtgttctggaattctatgtgagggagaaacattcagaacccagcagcagtgatctggaatcctatgtgatagccatacatgtagaccccagcagcaatgttctggaatcctatgtaagggacaaattttcggaccccagcagcagtgttttgcaattctatgtgtgtgacaaatattcagacccttgtagcagtgttctggaatcctatgtgagggacaaacactgagaatctagcagcagtgttctgcaaccctatgtgagggacagacattcagaccacagcaggagtgttctggaatcctatgtgagggacaaacattcagacaattgtagcagtgttggggaatcctacatgagggacgaacattcagaccctcgtatcactgttctggatccgaagtgaggaacaaatattcagaccacagcagagtgttctgaaatccagagtgagggacaaactttcagaccctcgttgcagtgttccggaatcctacggagtgacaaacattcagacaatcatagcagtgttctggaatcctatgttagggaaaaaccttcagactcaagcagcagtgttatggaatcctatgtgagaaacaaacattcaaacaacagcgggagtcttctggaatcctaagttacggacaaacattcacaccctcgtcacagtcttctggaattctatgtgagggaggaacactcagaatcctgcagcattgttctggaatcccatgtgacggacatacatgtagacccctgcagccgtgttctggaatcctatgtgagggacaaacattcagaacccagcagcagtgttctggagtcccatgtgagggaccatcattcagaccatcatagcagtgttctggaattctgtatgagggacaaacattcagaccctcatagcaatgttctggaattttgtgtgagggacaaacattcagacccttgtagcagtgttctggaatcctgtgtgaggaacaaacattcaggccatggtagcagtgttctggaatcctatgtgagggacaaacaaaaacaagagcgacagtgttctggaatcctatgttgcagacaaacattcagacgctcgtcacaatgttctggaattctatgtgagggagaaacagtcagaacccaatagcagtgttctggaatcctatgtgacggacatacatgtagaccccagcagcagtgttttggaatcctatgtgagggacagtcattcagaccctcgtagcagtgttctggaattctgtgtcaagcacaaacattcagacccccatagcagtgttctggaatcctatgtgagggacaatcattcaggccatagcaggagtgttctggaatcccctgtgaggaataaacgttcagacagtcgtagcagtgttctggaatgctatgtgagggacaaacattcagacaattgtagcagtgttccataatcctatgtgagggacaaacattcaaacaacagcgggattgttcaggaatcctatgttatggacaaatattctgaccctcatcgcagtgttctggaattctatgtgagggagaaacactcagaaaccaaaagcagtgttctggaatcctatgtgatggacatacctgtagaccctagcagcagtgttctggaatcctatgtgagggacaaacattacgaccccagcgacagtgttctggaatcctatgtgatggccaatcattcagacactcgtgccagtgttctggaattctgcatgacagacaaacattctgactcccgtagcagtgttctgtaggcctgtgtgagggaaaaacattgagaccacagcaggagtgttctggaatcccctgtgaggaacagacattcagaccttcttaggagggttctggaatccggtgtgatggacaaaaatctagaccctagcagcagtgttctgggatcctatgtgagggtcaaacattcagacccttgtaggagtgttctggaatcctatgtgagggagaaacactcagaacccagcagcagtgttctgaaaccctatgtgagagacaaacattctgacaacaggaggatagtttctggaatcctaggtgagggacaaacactcagaaaacaacaggagtgttttggaatcctaaatgagggacaatcattcagatcgtcatagcagtgttctggaattttgtgtgagggacaaacattcacaccccagcagaagtgttgtggaattctaaatgagggacaaacattcagaccctcgtagcaatgctctggaatagtgtgtgatggagaaacttttagaccccagcagcagtgttctgtaatcctttgtaagagaaaaacaatcagaccctcatagctgtgttctggaatcccatgtgatggacaaacactcagaacccagcagcagtgttctgtaactatatgtgaggggcaaatattcagaacacagcaggattgttctggaatcccatgtgagggacaatcattcagaccctcgtggctgtgttctggaatcctaagtgagggacaaacattcagacaatcatagcagtgttctggaatcccatgtgagagaaaaacattcggaccctcccagcagtgttctggaatcctatgtgagggacaaacattcagacaaacgtagcagtgttctggaaacctatgtaagggaaaaacattcaaacaacaccgagattgttctggaatcctatgtaacggacaaccattaataatctcttcacagtgttatggaattctatgtgagggagaaacacacagaacccagcagcagtattctggaaacctatgtgagggactcacattcagaccacggcaggattgttctggaatcctatgtgagggacaaacactcggaacacagcaggagtgttttggaatcctatgtgcggaacaaacattcagaacctcgtgacagtgttagggaatcctataggaggaactaacattcagaacacagcaggagtgttctggaatcctatgtgaagaacaaacattcagacccccatagcaatgttttggaatcctatgtgaaggacaaacattcagacaatggtagcagtgttctggaatccaatgtgagggacaaatatttaagctacggggagggggtttctggaatcctatgttacagacaaacattcagaacctcgtcgcagtgttcttgaattctatgtcagggaaaaacagtcagaaccccgcagcagtgttttggaatcctatgtgacagacacacatgtagaccccagcaacagtgttctaggatcctatgtgagggaaaaacattcagaccccggcagcagtgttctcgaatcctatgtgaggggcaatcattcagaccgtcgtagcagtgttctggaattctgtgtgagggacaatcattcagactgtcgtagcagtgttctggaatactaagtgtaggacaaacattcagacaatcgtagcagtgatctggaaatctatgtgagggacaaacattcacacactcttaggagggttctggaatcctatgtgagggacaaacattcagacaatagtagcagtgttctggaatcctctgtgagggacaaacattcagaatccaacagcagtgttctggaatccaatgtgagggacaaacatttaaacaacgggcggggggcgttctggaatcctatgttacagacaaacattcagaacctcgtcgcagtgctatggaattctatgagagggagaaacagtcagaacccagcagcagtgttttggaatcccacgtgacggacatacatatagaccccagcagcagtgttctgggatcctatgtgagggacaaacattcagaccccagcagcagtgttcacgaatcctatgtgagggacaatcattcagaccccaagggccccaaatatgcacttgcagattctactaaaagagtgtttccaaactgctcaatcaaaagaatggttcaactctgtcagatgaatgcacacatcagaaagaattttctcagattgcttcagtctagattttatgtgaagatatttccttttctaccataggcagcaaagtgctccaaatgtccacttgcagattctacaaacagaagctttctaaactgctcgagcaaaagaaaagtttaactctgtgagatgaatgcacacatcacaaagaagtttctcagattgcttctgtctagattttatgtgaagatatttccttaccaccataggcctcaaagcactgaaaatgtccacttgcagattctacaaaaagagtttcaaaactgctcaatcaaaagaaaggtttaacactgtgagatgaatgcacacatcacaaaaaagtttctcagaattcttctctctagtttttatgtgaagatatttcattttccaccataggcctcgaagcattccaaatgtactcttgcagattctgcaaaaagagagtttcaaaactgctcaatcaaaagaaaggtttaactccgtgagatgaatgcacaagtcacaaagaagtttctcagattgcttctgtctagattttatgtgaagataattccttttctaccataggccacaaagcactccgaacttccatttgcaggttctacaaaaagagtgtttccaaactgctcaattgaaagaaaagttcaactctgtgagacaaatgcacacatcacaaagaactttctcagaattctgtccagtttttatgtgaagatatttcctttccaccataggcctcaaagcgctaaaaatgtccacttgcagattctacaaaaagagttttgaaactgctcaatcaaaagaaaggtttaactctgtgacatgagtgcacacatcccaaagaaatttctcagaattcttctgtctagtttttatgtgaagatatttccttttccaccataggccgcgaacctttccaaatgtactcttgcagattgtacaaaaagagagtttcaaagctgctcaatcaaaagaaaggtttaactctgtgagatgaatgcacacatcgcaaagaagtttctcagattgcttctgtctacattttataggaagatatatccttttctaccgtaggcctcaaagcgcaccaaatgtccacttgcagtttctacaaaaagagtgtttccaaactgctcaatcaaaagaaaagttgaactctgtgagatgaaagcacatatcacaaggaagtttctcagaattctgtctagtttttatatgaagatatttccttttccaccataggcgtcaaagcactaaaaatgtccacttgcagattctacaaaaagagagtttcaaaactcaatgaaaagaaatgtttaactctgtgagatgaatgcacacatcacagggaagtttctcagattgtttctgtctagactttacgtgaagatacttcgttttcttccataggaccaaaagcgctccaaatgtccacttgtagattcaacaaaaagagtgtttccaaactgttgaatcaaaataaattttcaaatctgtgagttgaaagcacacatcacaaagaagtttgtcaggattcttctatctagtttttatgtgaagttatttccttttctaccacaggccgcaacatgctccaaatatctacttgcagattctacaaaaagagtgtttccaaactcctcaatcaaaagaaatgttgaactctgtgagatgaatgcacgtgtcacaaagaagtttctcagattgcttctgtctagattctatgtgaagatatttccttttctagcaaaggctgcaaagcgctccaaatgtccacttgcagattttacaaaaagagtgttttcaaactgctcaatcaaaagaaaggctcaagtctgtgagatgaatgcacacatcacaaagaattgtctcagaattcttctgtctagtttttaagtgaagatatttcctttccaccataggcctgaaggcgctccaaatgtccacttgcagattctacaaaaagagagtttcaaaacgcctcaatcaaaaggaagggttaactctgtgagctgaatgcacacatcacaaagaagtttttcatattgcttctgtctggattttgtgtgaagatatttccttttctacagtaggctgcaaatagctctaactgtccagttgcagattctacaaaaagagtgtttccaaactgcttaataaaaagaaagcttcaactctgtgagatgaatgcacatatcacaatgaagtttctcagaattcttctgtctagttttacatgaagatatttccttttccagctgaggcctcaaagtgctcaaattgtccacttgcagatactacaaaaagagagtttcaaaactgctcagtcaaaataaaggcttaactctgtgagatggatgcacacatcacaaagaagtttcacagattgcttctttctagattttatgtgaagatatttccttttctaccataggctgcaaagtgttccaaatatccacttgcagattctacaaacagaggctttccaaactgctcaataaaaagaaaagtttaactctgtgagatcaatgcacacatcacaaagaagtttctcagaattcttctgtccagtttttatgtgaagatatttccttttcggccataggcctcaaagcgctccaaatgtccacttgcagtttctacaaaaagagagtttcaaaactgctcaatcaaaagaaaggtttaactctatgagatgaatgcacacatcataaagaagtttctcagattgcttctgtctagattttatgtgaagatatttccctttctaccacaggccccaaagcactccaaatgtccacttgcagattctacaaaaagagtgattccaaactgctcaatcaaaagaaaggctcaactctgtgagacgaatgcacatatcacagagaagtttctcagaattcttctgtccagtttttatgtgaagatatttacttttccaccataggcctcaaaccgctccaaatgtccacttgaagattctacagaaagagtttcagaactgctcaatcaaaagaaaggtttaactctgtgagttgaatacacatatcacaaagaagtttctcaaatttcttctgtctaggttttatgtgaaggtatttccttttctactgtaggccacagagtgcaccaaatgtacactagtaggttgtacaaaaacagtgtttccaaacttctgaatcaaaagaaaagttcaactctgtgagatgaacacacatatcacaaagaagtttctcagaattcttctgcctagtttttatgtgaagatatttccttttccaccataggcctcaaagggctccaaatgtccacttgcagattctgcaaaaagagagtttcaaaactcctcaatcaaaagaaatgtttaactctgtgagatgaatgcacacatcacagaaaagtttctcagattgtttctgtctggtttttatgtgcagatatttcctttccacgttaggcctcaaagcgctccaaatgtcaacttgcagattctacaaaaagagtgtttccaaactgttgaataaagagaaattttcaaatctgtgagatgaaagcacacatcacaaagaaatttgtcagattgcttctgtgtagattttatgtgaaggtatttccctttctaccataggccacaacatgctctaaatatccacttgcagattctacaaatagagtgtttctaaactgctcaatcaaaagaaaggttcaactctgtgagatgaatgaacacgtcacaaacaagtttctcagaattcttctgtctagtttttatgtgaagatatttcatttttccaccatagactcaagaagctcaaaatgtccacttgcagattctacaaaaagagtgttttaaagctggtccaacaaaagaaaggttcaactctgggagatgaatgcacacatcacaaagaagtttctcagattgcttctgtctagattttatgtgaagatatttcgttttctaccacaggccacaaagcactcgaaatgtccacttgcagattctacaaaaagagtgtctccaaactgctcaatcaaaagaaagtttcaaatctgtgagatgaacacacacatcacaaagaagtttctcagaattcttctgtctagtttttatgtgaagatatttccttttccaccttaggcctctaagcgctccaaatgtccatttgcagattctataaaaagagaggttcaaaactgctccatcaaaagaaaagtttaactctgggagatgaaggcacacatcacaaagaagtttctcagaatgcttccatctagtttttatgtgaagttattttctttccaccataggcctcaaagtgctaaaaatgtccacttgcagattctacaaaaagagttttgaaactgctcaatcaaaagaaaggtttaactctgtgagatgagtgcacacatcacaaagaaatttctcagaattcttctgtctactttttatgtgatgatatttccttttcgaccataggtgtcaaagcactaaaaatgtccacttgcagattctacaaaaagagagtttcaaaactgctcaatcagaagaaaggcttaactttgtgagatgaatacacacatcacaaagaagtttctcagattgcttctgtctagattgtatgtgaaggtatttccttttctactgtaggcctcaaagcacacaaaatgtccactcgaagtttctacaaaaagagtgtttccaaactgctcaatcaaaagaaaagttgaactctgtgagatgaaagcatatatcacaaagaagtttctcagaattcttctgtctactttttatatgaagatatttccttttccaccataggcatcaaagcgttaaaaatgtccacttgcagattctacaaaaagagagtttcaaaactcctcaataaaaagaaacgtttatctctgtgaggtgaatgcacacatcacagagaagtttctcagattttttctgtctagattttatgtgaagatacttcattttattccataggatgaaaagtgctccagacgtccatttgtagattcaacaaaaagagtgtttccaaactgatgaatcaaaagaaattttcaaatctgtgagatgacagcacacatcacaaagaagtttgtcagaattcttctgtctagtttttatgtgaagatatttcctttccaccgtaggcgtcaaagcactccaaatgtctacttgcagattctacaaaaagagagtttcaaaactactcaatcaaaatgaaggtttaactctatgagaagaatgcacacatcacaaagaagtttctcagattgcttctgtctagattttatgtgaagatatttccttttctaccataggctgcaaagcgctctaaatgtccacttgcagattcaaaaaaaaagtgtttccaaactgctcaatcaaaagaaaggttcaactctgagtgatgaatgcacacattacaaagaagtttctccaaattcttcagtctagtttttgtgtgatgatatttcctttttaatcataagactcaaagcactccaaatgtctactagcagattctacaaaaagagtctcaaaactgctcaatcaagagaaagtgttaacactgtgagatgaatgcacacatcacaaagaagtttctcagattccttctgtctagattttatgtgaagatatttgcttttcttccattggttgcaaagcgctacaaatctccacttgcagattctacaaaaagagtgtttccagactgctcaatcaaaagaaaggttcaactctgtgagatgaatgcacacatcacaaggacgtttctcagaattcttctgtctagtttttatgtgaagatatttccttttttaccataggtctcaaagcgctccaaatgtccacttgtagattatacaaaaagagtttcaacactgctctatcaaaagaaaggtttaactctgtgagatgaatgcatacaccagaaagaagttcctcagattacttctgtctggattttatgtgaaggtatttgctttactaccataggccgcaaagcgatcctaatgtccaattgcagattctatgaaaagagtgtctccaacctgcccaatcaaagcaaagtttcaacactgtgagatgaacacacacatatcaatgaagtttctcggaattcttctctctagtttttatgtgaagatatttccttttctaccataggccacaaagtgccgcaaatgtcgacatgcagattctacaaagagtgtttccaaactgctcaatcaaaagaaaagttcaactctgtgagatgatcgcacacatcacaaagtagtttgtcagaattcttctgtctagtttttatgtgaagatatttccttttccataatattcctcaaagctctcgaaatgtccacttgcagattctacaaaaagagtgtttccaaactgctcgatcaaaagaaacgtttaactctgtgagatgaatgcacacatcacaaagagatttctcagactgcttctgtctagatattatttgaagatatttccttttctactgtaggccacaaagagctccaatttccacttgtagattctacaaaaagtgtgtttccaaactgctcaatccaaagaaagattcaactctgtgagatgagcacatgcatcacaaagaagtttctcagaattcctctgtctagtttttaagtgaagatttttcattgtccaacatagacctcagaacgctccaaatgtccacttgtggatactccaaaaagagtgtttcaaaactgttcaatccaaagaaagttttacctctgtgagatgaatgtacatatcagaaagaagtttcacagattgcttttgtctagattttatgtgaagatatttccttatctaccatacatagaccacaaagcgctccaaatgtcctcctgcagatactacaaaaagagtgtttccaaactgcccaatcaaaagaaaagttcaactgtgtgagatgaatgcacacatcacaaagaagtttgtcagaattcttctgtctagttttcatatgaagatattaactttttcaccataggccacaaattgatccaaatgtccacttgcagattctacaacaagagagtttcaaaactcctctatcaaaagaaaggtttaatacagtgaggtgaatgcacatatcacaaagaagtttctgagattgcttctgtctagatattatgtgaagatatttcgttctctaccataggctgcaaagcgctccaaatgtccactgacggattctacaaaaagagtatttccaaactgctcaatcaaagaaaggttcaactctgagatgaatgcacacatcacaaagatgttgctcagaattcttctgtctagtttttatgtgaagttatttccttttccacagcaggcctcaaactcctccaaatgtccacttccagatcctacaaaaaaagagtttcaaaattgctcaatcaaaagaaagatttaacgctgtgagatgaatgcacatataagatagaagtttctcagattgcttttgtctagattttatatgaagatatttccttttctaccttaggccgcaaagcgctccaaatgtccacttgcagattccacaaaaagagtgtttccaaactgctcgatcaaaagaaaagttcaactctgtgagatgaatgcacacatcacaaagaattttctcagaattcttctgtctagctttaatgtgaagatatttcttatgccccaataggccccacaacaggcctcgaagccctccaaatatccacctgcagattccacaaaaagagtgcttccaactgctcaatcaaaagaacggttcaactctgtgagatgaatgcacacatcacaaagaggtttctcagaattcttctgtctagtttttatgtgaagatatttcctcttccactacaggtctcaaagtgccccaaatgtccactttcagattctagaaaaagagaatttcaaaactgctgaatcagaagagaggtttaactctgtgagatgaatgcacacatcacaaagaagtttctcagattgcttctgtctagatttttttgaaaatatttagttttcttatgtaggccacaaagcgctaaaaatgtccacttgcagattctacaaaatgagtgtttccaatctgctcaatcaaaagaaactttcatctctgtgtgatgaacacacacatcacaaagaagtttctcagaattcttctgtctagtttttatgtgaagatatttccttttccaccataggccccaaagcactacaaatgtccacatgcagattgtactaaaagagagtttcaaaactgctcaatcaaaggaaacgttaactctgttagatgaatgcacacatcacaaagaagtttctcagattgattctgtctagattttatgtgaagatatttccttttctcccataggctgcaaagccctccaaatgtccattttcatattttacaaaaagagtgtttccaaactgctcaatcaaaagaaagattcaactctgtgagatgaacgtacacatcacaaagtagtttctcagaatttttctgtctagtttttaattgaagatatttccttttccaccataggcctcaaagtgttacaaatgtccatttgcagattctataaaaagagattttcaaaactgatcaatgaaaagaaaggtttaagtctatgagatgaatgcacacataataaaaaatttataaggttgcttctgtctagattttatgtgaagatgtttccttttctaccataagccacaaagcactccaaatgtccacttacagattgtacaaaaacagtgtttccaacagctcgatcaaaagaaaagttcaactctgtgagatgaatggaaacatcacaggcaatttctcagaatgcttctgtttcatttttatttgaagatatttccttttccacaatagtcctgaaagcgctccaaacatccaattgcagattctacaaaaatagtgtttcaaaactgctcaatcaaaagaaaggttcaactctgtgagattaatgcacacatcacaaagaattttctcagaattcttctgtctagctttaatgtgaagatatttcctactccccaataagccccacaataggcctcaaagccctccacatatccacctgcagattccacaaaaacagtgcttccaaactgctcaatcaaaagaaagattcaaccctgtgagatgaatgcacacatcacaaagaggtttctcagaatacttctgtctactttttatgtgaagatatttcctcttccactagaggtctcaaagtgccccaaatgtccactttcagattctagaaaaagggagtttcaaaactgttgaatcagaagagaagtttaactctgtgagatgaatgcacacatcacaaaatagtttctcagattgcttctttctagatttcatgtgaagatatttccttttctaccataggctgcaaagctttccaaatgtccacttgcagattctacaaaacgagtgtttccaaactgctcaatcagaagaatgattcaactctgtgagatgaacacacacatcacaaagtttctgagcattcttctgtctagtttttatgtgaagttatttccttttccaccataggcctctatgcgctccaaatgtccacttgcagattcctgaaaaagagagtttcaaaactgctcaatcaaaaaaaggtttaactctgtgagatgaatgcacacataacagaaatatttctcagattgcttctgtctagattttatatgaagatatttacttttctaccataggcgacaaagcgcacattatgttcacttccaaatactccaaaaagagtgtttccaaacttctcaatgaaaagacagtttcaaatctgagagatgaacgctcacatcacaaagaagtttcacagaattcttcagtgtagtttttatgtgaagatatttccttttccatcacaggtctcaaagcgctccaaatgtccacttgcagatgctacaaaaagagagtttcaaaactcctaaatcaaaagaaaggttttactctgtgagatgaatgcacacatcaaaaagaagtttctcagattgcttctatcgagattttatatgaagatatttccttttctaccataggcagcaaatcgctccaaatgtccacttgcagattatacaaagagtgtttccaaactgctcaataagaagaaaggttcaactctgtgagatgaatgagcacatcagaaagaagtttctcaaaattcttctgtctagttcttatgtgaagatatttattcttccaccataggtcgcaaaacgctctaaatatccacttgtagattctacaaaaagagtgttttcaagttgctcaatcaaaagaaaggttcaactctgtgggaggaatgcacacatcacaaagaagtttctcagaattcttctgtgtagtttttatgtgaagatgttaccttttccaccataggcctcaaatcgctccaaatgtccacttgcagattctacaaaaagagagtttcaaaactgctcaataaaaagaacagtttaactctgtgagatatatgcacacatcacaaagaagtttctcagattgattctgtctagattttatgtgaagatatttcctttcctaccataggctgcaaagccctccaaatgtccacttgcaggttgtacaaaaagagtgtttccaaactgctcaatcaaaagaaatgttcaactctctgagatgaacgcacgcatcacaaagaagtttcttagaattcttctgtctagtttttatgtgaagatatttccttttccaaaataggcctgaaagcactccaaatgttcacttgcagattctacaaaacgacagtttcaaaactgcttaatcaaaagaaaggtttatctctctgagctgagtgcacacatcacaaaaaatttctcagattgcttctgtctatattttatgtgaagatgttaccttttctaccataggctacaaagcactccaaatgtccacttgcagattctacaaaaagagtgtttccaacagctcaatcaaaagaaaacttcacctctgtgagaccaatgaacacaccacaagcaagtttctcagaatgcttctgtttagtttttatttgaagatatttccttttccacaatagtcctgaaagcgctccaaacatccacttgcagattgtacaaaaagagtgttccaaaactgctcaatcaaaagaaaggttcaactctctgagattaatgcacacataacaaagaagattctcagaattcttctatctagttttaatgtgaagatatctcctattccacaataggccccacaataggcatcaaagccctccaaatatcctcctgcagattccacaaaaaggatgtttcaaaattgctcaatcaaaagtaagtttcaactgtgtgagatgaatgcacatatcacaaagaaggttgtcagaatgcttcgatctagtttttatctgaagatatctccttttccaccatagtcctaaaagtgctccaaatgtccactagcacattgtacaaaaagagcatttccaaactgctcaatgaaaagaaaggctcaactctgtgagatgaatgcacacatcacaaagaaatttgacagaatgcttctgtttagtttttatgtgaagatgttttcttttccaccagaggcctcaaagtgctcccaatgtccacttgcagattttatgaaaggagtgtttcaaagctaatccaacaacagaaaggttcaactctgtgagttgaatgcacacatcacaaagaagtttctgagaatgcttctgtctagttattatgggaagatatttcgttatccaccataggcctcaaagcactccagatgtccacttgcagattctgcaaaaagagtgtttcaaaactgctcaactgaaagtaaaattcaactcggtgagatgaattcacacttcacaaagaaacatctcagaatccttctgtctagttcttatgtgaaggtatttcgatttccaccataggcctcaaagcgcccctaatgtccacttgcagattctacaaaaagagattttcataattgctcagtgaaaagaaaaagttaactctgtgagatgaatgcacatatcacaaagaagtttttcagactgcttcagtctagatgctatatgaagatatttccttttctaccttagacagcaaagcgctccaaatgtccaatttcagattatgcaaaaacagtgtttcaaaactgctcaatcaaaagaaaggttcaacactgtgagatgaacgcacacatcacaatgatgtttctcagaattcttctgtctagtttttatgtgaagatatttccttttacaccataggcctcaaagtgctaaaaatgtcaaattgcattttctacaaaaacagagtttcaaaactgcacaatcagaagaaaggtttaactctgtgagatgaatagacacatcacaaaaagtttctccgattccttctgtctagattttatgtgaagatattttctttactgccataggccacaaagcgctccaaagatccactagcagaatcatcaaaaagattgtttccaaaatgctaaataaaagaaagtttcaactctgtgagatgaccacacaaatcacaaagaagtttctcagaattcttctgtctagttattatgttaagatattcccttttccaggataggcctcaaaccgctccaaaggtctacttgcagcttctacaaatgagagtttcaaaactgctcaatccaaagaaaggtttaacatggtgagataaatgcatacatcacaaagaagtttctcagattccttctgtctagattttatgtgaagatatttcctattctaccatagcacgcaaagcgctttaaatgtccacttgcagattcttcaaaaagagtatttcaaaactggtctttcaaaggaaagattcaactctgggaggtgaatgcacacatcacaaagaagtttctcagaatgcttctatctagtttttatatgaagatattaccttttccacattggcctcaaagtgcttgaaatgtccacttgcagattctacaaaaagagtgtttccaaactgctcaatcaaaagaaaggttcaactctgtgagatgaacacacgcatcacaaataagtttgtcataatgcttctgtctagtttttatgtgaagatatttgattttccataataggcctcaaagtgctccaatgtccacttgcagattctacaaaaagagtgtttcaaagctgctcaatgaaaagaaagttacaattctgtgagatgaatgcacacatcacaaagaagcttgtcagaatgcatctgtctaatttttatgtgaaaatattcccttttccaccataggcctcaaagtgctccaaatgtccacttgcagattctacaaaaagcgtgtttcaaagctgctcgatcaaaagaaaggttcacgtctgggagatgaatgcacacatcacaaggaagtttgtgagaatgcttctgtctagttttcatgtgaagatctttccttttccaccagagacctcaaggcgctccaaatgtccacttgcagattctacaaaaagagagatgcaagactgctcaatgaaaagtaacgttcaattctgtgaggtgaatgcacacatcaaaaagaagattctcagaatttttctgtgtagtttttatgtgaagatgtttcattttccaccatagaccacaagatgctcgaatagtccacttgcagattctacaaaaagattgtttcaaagctgctcaaacaaaggaaaggttcaactctctgagatgaaggcacatgtcacatagaagtttttcaaaaagcttctgtcttgttttcatgtgaagataatttcttttccaccatggacatcaaagtgctgcaaatgtccgcttccagattctacagaaagagtgtttcaaagctgctcaatgaaaagtaaggttcaactctgtgagatgaatgcacacatcacaaagaagtttgtcagaatgcttctgtctagtttttatgtgaagatatttccttttccaccataggcctcaaagggctccaaatgtccacttgcagattctagaaaaagagtgtttcaaaactgctcaatgaaaagtaggtttatactctgtgagatgagtacacacattacaaagttttttgtcagaatgcttctgtctagttttcatgtgaagatatttccttttccaccatagacctcaaagcgctccaaatatccatttgcagattctacaaaatgagtgtttcaaaactgctcaatgaaaagaaaggttcacctctgtgagatgaatgcacacatccaagagaagtttttcagaatgcttctgtctagtttttatgtgaagatattttcttttccaacataggcatcaaagcgctcctaatgtccacttgcacattctacaaaaagagtgtttcaaagctgctcaatgaaaagtaaggttcaactctatgagatgaatgcacaaatcacaaagaagtctgtcagaatgcttctgtctaggttttatgtgaacatatttccttttccatgataggccccaaagcgttccacaggtccagttgcagattctacagaaagagtgtttcaaagctgctcaatcaaaagaaacgttcatctctgtgacatgaatgcacagatcacaatgaagtttatcagaatgcttctgtctattttttttgtgaaaatatttccttttccaccataggcctcaaagtgctccaaatgtccacttgtagattctacaaacagagtgtttaaaaactgctaaatgaaaagaaagattcaactgtgagatgaatacacacttcatgaagaagtttgtcagaatgcttctgtctagtttttatatgatgatatgtccttttccacaataggccagaaagtgctcgaaatgtccacttgcagattcaacaaaaagagtgtttcaaagctgctcaatgaaaagaaaggttcaacactgtgagctgaatgcccacatctcaaagaagtttgtaagaatgcttctgtctagtttttatgtgaacatatttccttttccacggtaggcctcaaagctctccacatggcctcttgcagattctaaaaaaagagggtttcaaagctgctcaattaaaagaacagttcaactctgtgtgagatgaatgcaaacatcacaaagaagtttctcataatgcttctgtctagttttgttgtgaagatatttccttttccaccataggcctcaaagttctccaaatgcacacttgcagattctacaaaaatggtgtttcaaaactgaccaatcaaaagtaaggttcaactctttgagatgaatgcagacatcacaaagtagtttttcagaatgcttctgtccagtttttatgtgaagataagtcgttttctactataggcctcaaagcactcgaaatgtacacttgcagattctaaaaaaagtgtgtttcaaagctgctcaatcaaaagaaaagttcaattctgtgagatgaacgcatgcctcatgaagaattttgtcagaatgcttttgtcttttttttttttttgtgagcaacaaggctgtttatttcacctgggtgcaggtgggctgagtctgaaaagagagcaaagggtgatcggattatcattagttcttataggttttgggataggcagtggagttaggagcaatgttttgccggcaggggttggatctcacaaagtacattctcaagggtggggagaattacaaagaaccttctcaagggtgagggagattacaaagaactttcttaagggtgggggagattacaaagtacatcagttagggtggggcagaaacaaatcacaatggtggaatgtcatcagttaaggctattttcacttcttttgtggatctgggacgtgaggagtgcctctgcccggccgccccatctgggaagtgaggagctcctctgcctggccaccccgtctgggaagtgaggagcgcctctgcctggctgccccatctgggaagtgaggagtgcctctgcctggccaccctgtctgggaggtctaccacggaggccagacgcagtgtgggggctggacgtggtggctcacgcctgtaatcccagcactctgggaggccaaggcgggttgatcacttgaggctaggggtttgagaccagcctggccaacatggcaaaacatatgaaaattacaacaaaccaaccaaccaaccaacccagcaacaacaaaacaggtctaccctggagtcatactctaagtttttctattttcctccctttctgatcctttatcccactttctttttcttcctcttccttctccttcttttcaaagacatagaggattgagttattatcattgatcaatacaaagtccctctctcatttattttctttcattcccaccccccatttctattccccatcttcccatgtgcaaccttcctaatatgtttgatatgcttctttttgtatatatttttagaaaatgttaaataaaaaaatttttttaaaaagccctgcaaaggcaggaaagctgaactggctgctgagccccttctggttggccacacagtacccacacctgtagcccctggactcctagtgtgggctaaggtggagtggaccctctggcttggtcacagcacaatgggccacctggaaaccatccaaaagagaagacctaccagcccgtgcccaaggtgcagctgccacctgcacatcaggcaccagcagcaatggccagaccatccctgattctccatgccatccccatccccgccccaacaacaagtactccctgacaggatgctgcagtagtggctgtcgggaagtcggctgggcaggtgcataacgataaagatagactctcagccccatcccgatggccacgatgtgctcatcccctggcggctcctcagccctatcctagtggccatggagtggcatgcaggcagcagccttgggaaccctgattgcccctcctcacacgtgcccatcacaagacttgggcgacggggaggtcaagtcagactgtggccacagcggcaccacgaggccaagaaccggcactcagcctcaacgccatggatgcagggtgccaagtgccaggtcctgcactctgggcatgggtcaggagcagctggcaagggcagcgcagcctgtcgggccctggggcatggccggccgcagctccgggaagccactgcagctctgggaagccacgttggcccacagacactgcagctgcagccgccaccagcacatggagcaggggtcgctgaggattgggaatccgtgaccaggcgagcgcctccagccgcgcggaccccggggccagcccggcctcagcaagtcaggtagtctgcggcaggagcgccgggcatgggttttggcccgcggtgcaggaggcatgcacactctggccagatgggcggtgcactcagggcccaggaggccatcccaggggaaccccgccagcctctgccagagcccgagctgcagctgccacctgcaagtggtgcactggctgcagcggtggcaacccctgatcccatcctcccacctcacttccatcagcgcagaccccacgggtgacgtagtgacgaagtagggctgtgggcccagtggcagcaccaggcggagaagcaccactcaatcccatccctgggctgcagagggcccagcgtggggggctccaagcatcgggagccagtggaagaggagaagagcgcgtgggcgacagtcaaacaggccctggggcagggtgtgcctcatgctccagggagccccgccagcccgaggcacctgagcagaaatcgccgcctgcactgggcgccacgagagagtgttagggccgtttctccacctcgggcctgttgcgcggggccagctaaggtgcacatgctcactggtcctaaccattctgttgggcatttctgctgagaggcgggcagtgctgagtctgtgcaaaggtccatgggcagactgcattgcttgttgttgtgcttcggaggtggcgatccccgaaggtgagctgaaatatggctggagcgttcccaggctacaatttgcagtgacaattatggaagatgagccggagtggtggcccaccctcagggagcacttgtgttcggatggcttctcatttccccagtaccacattaaatcatctcatctgaggaggatccacagagctgtcttctgtggtaatctggagaaagtgaactacctttgtctgagtagttgtcgaccttgtttccacattaactggctgttttgttgtggctgcacttctgtttcattaccttcatcttgcaggacggagtcttggctgcagactcagcctgtacctcacccgtctcccaccgactcttggtactggccatggccatgctgggcagctctatggaggcctggtgggctaccttgggggttcggccagtggtcctttcacagctggggagtggagcctgggcctgcggtagtgctgtgcgcctcccggcacctgcggcggtgctgtgcacctcccggcgcctgcggcggtgctgtgcacctcctggtgcctgcggcggtgctgtgccttttgtctactttttatatgaagatatttccttttccaccgtaggcgtcaaattgctccaaatgtccgcttacagattctacaaaaacagtgtttcaaaactgatcaatgaaaagtaaggttcaactctgtgagattaatgcacacatcacaaggaagtttgtcagaatgcttctgtctcgtttttctgtgaagatattttcttttcttctataaccttcaaagtgctccaaatgtccacttacagattctccaaaaagagtgtatcaaagctgttcaatctaaagaaaggtgcaactctgtgagatgaatgcatacatctcaaagaagtttgtcagaatgcttctgcttagtttttatgtgaagatatttccttttccacaataaggctcaaggcgctccaaatgtccacctccagatactacaaaaatagtgtttcaaaactgctcaatgaaaagtaaggttaaactctgtgagaggaatgcacacatcacaaagaagtttgtcagaatgcttctatctagtttttattgtgaagatatttccttttccaccataggccacaaagtgctccaaatatccacttgcagattctacaaaaagagtgtttcaaatctgatcaatcaaaacaaaggatcaaatctgtgagatgaatgcaaatatcacaaataagtttgtcagaatgtttctgtctagtttttatctgaagctgtttccttttccactattggcctcaaagtgttccaaatatgccacttgccaattctacaaaaagagtgtttcaaaactgctcaatgaaaagtaaggttataatctgtgagacgaattcacacatcacaaagaagtttgtcagaatgcttctgtctagttttcatgtgaagatatttccttttccaccataggcctcaaagggctccaaatgtccgcttgcagattctacaaaaagattacaaagcagctcggtaaaaagaaaggttcaactctgtgagatgaatgcacacatcaaaaagaagattgtcagaatgtttctgtattgtttttatgtgaagatatttccttttctaccataggtctaaaagctttctagcatccacttgcggattctacaaaaagagtgtttcaaaactgctctatgaaaaggaatgttcaactcagtgagttaaatgcaagcatcacaaagaagtttctgagaatgcttctgtctagtttttatgtgaagatattcccgtttccaatgaaagcttcaaagctatccaaatatccacttgcagattctacaaaaagagtgtttcaaaactgctgtatcaatagaaaggttcaactctgtgagttgagtacacacatcaaaaagaagtttctgagaattcttctgtctagtttttatgcgaagatatttcctttttcaccataggcctctaagcgctccaaacgtccccttacagattctacaaaaagagtgtttcaaaactgctctatgaaagggaatgttcaactctgtgagttgaatgcaaacgtccagaggaagtttctcagaatgcttctgtctagttttatgtgaaaatattcccgtttctaacgaaatcctcaatgctctcctaatatccacttgtaaattctacaagaagagtttttcaaaactgctgtatcaaaggaaaggtttaactctgttacctgagtacacacatcacgaagtagtttctgagaatgcttctctctacttttcatgtgaagatatttcctctttcaccataggagtcaaatcgctcaatatgtccacttgcagataatacaaaaggaaagtttcaaaactcctctatgaaaaggaatgttcaactcggtgagttgaatgcaaacatcacaaagtagtttctgagaatgcttccgtttagtttatatgtgaagatattcccatttcaaaggaaatcctcaaagctgtcataatatccacttgtaaaacctagaagaagagtatttcaaaacagctctatctaaagaaatgttaaattctgtgagttgagtacacacatcataaagaagtttctgagattcattcggtctagtttttatgagaagatatttcctttttcaccataggcctcaaagtcctccaattgtccaattccagatactacaaaaagagtgtttcaaaactgctctatgaaaggaaatgttcaactctgggagttgaatgaaaacatcccaagaagtttctaagagtgattttgtgttgtttttatgtgaagatattcccgtttccaatgaaatcctcaaagctatccaaatatccacttgcagattctacagaaagagtgtttcaaaactgctgtatcaaaagaaaggttcaactctgtgagttcagtacacacatcacaaggaagtttctgagaattcttctgtctagtttttatgggaagatatttcctttttcaccataggcctcaaagcgctccaagtttccatttacagattctacaaaaagagtgttccaaaactgctctatgaaaaggaatgtgcaactcattgagttgagtacacacatcaaaaacaagtttctgagaatgcctctgtctagtttttatgggaagatatttcctttttcaccataggcctcaaagagctccatgtgtccactttcagatactacaaaaagagtgtttcaaacctgctctatgaaagcgaatgttcaactctgtgacttgtatgcaaacgtcacaaagatgtttctgagaatgcttctgtctagattttatatgatgatattcctgtttccaatgaaatcctcaaagcaatgcaaatatccactgcagattctacaaaaagagtgtttcaaaactgctctatcaaaagaaaggttcaactctgttagttgagtacacacgtcacaaacaagtttctgagaatgcttctgcctagtttttatgtgaggatatttcgtttttcaccataggcgtcaaagtgacccaaatgtcaactaccagatacaacaaaaatagtgtttcaaaacttctctatcaaaaggaatgttcatctctgtgaggtgaatgcaaacatcacacagtagtttctgagaatgcttctgtctggttttatgtgtagatattcccgtttccaacgaaatcctcaaaggtatccaaatatccacttgcagattcaacaaaaagtgtgattcaaaactgctctatgaaaagaaaagttcaactctgtgagttgagtacacacatcacaaagaagtttctgagaattcttctgtctagtttttatgggaggatattacctttttcaccatgggcctcaaagagctccaagtttccacttacacattctacaaaaggagtgtttccaaactgctctatgaaaaggaatgttcaactcagtgagttgaatgcaagcatcacaaagaagtttctcagaatgcttctgtctagtttttatgtgaaggtattcccgtttcaaatgaaatactcaaagctgtcctaatatccacttgtaaagactacaagaagagagtttcaaaactgctatatcaaaggaaaggtttaactctgtgagttgagtacacacctcacaaagtagtttctgagaatgcttctgtccactttttatgtgaaggtattttgtttttcagcacaggtctcaaatcactccaaatgtccacttgcagatttcacaaaaagagtgtttcaaaactgctctatgaaagggaatgttcaagtctgtgagttgaatgcaaacatcacaaagaagtttctgagaatgcttctgtctaatttttatgtgaagatattcccgtttccaacgaaagcctcaaagctatcaaaatatccacttgcagattccacaaaaagtgtgtttcaaacctgctgtatcaaaagaaatgttaaactctgtgagttgagtacacacatcacaaagaagtttctgagaatgcttctgtctcgtttttatgtgaggaaattttgtttttcaccataggcttcaaagcgctcaaaatgtccacttccagatactacaaaagagtgtttcaaaacttctctatggaaaggaatgttcaactctgtgagttgaatgcaaataccacaaagtagtttctgagaatgctactgcctggtttttatgtaaagaaaatcccgtttccaatgaaatcctccaagctatccacatatccacttgcagtttctacaaaaagtgtttcaaaactgctcgatcaatagaatagttcaactctgtgagttgagtacacacatcacaaggaagtttctgagaattctgtctattttttatgcgaagatatttcctttttcaccataggcttctaagtgaaccaaatatccacttacagaatctacaaaaagagtgtttcaaaactgctctatgaaaaggaatgttcaactctctgagttgaatgcaagcaacacgaagaagtttctcagaatgcttctgtctagttttatgtgaaaataatcccgtttccaatgaaaccctcaatgctctcctaaaacccacttgtaaaatctacaagaacagtgttccaaaactgctctatctaaagaaagcttcaactctgagttcagtacacacaacacaaggaagtttctgagaatgcttctgtctggtttttatggcaagatattccttttttcaccataggcctcaaagcgctccacgtttccacttacagattctaccaaaagagtttcaaaacagctctaagaaaagcaatgttcaaaacagtgagttgaatgcaaacatccgaaagaagtatctgacaatgcttctgtctagtttctatgtgaagatattcccgtttccaacgaaatcctcaaagctgtcctaatatccacttataaatactacaagtagagtgcttcaaaactactgtatgaaacgaaaggtttaactctgagagttgagtacacacatcacaaagtagtttctgagatgcttctgtctactttttgtgtgaagttatctcctttttcaccataggtctcaaatcgcaccaaatgtccacttgcacattcttcaaaaagagtgtttcaaatctgttctatgaaaaggaatgttcaactctgtgagttgaatgcaaacatcacaaagaagtttctgagaatgcttctgtctagcttttatgtgaagatattcccgtttccaacgaaagcctcaaagctatccaaatatccacttgaagattccacaaaaagagtgattcaaaactgctctatcaaaagaaaggttcaactctgttagttgagtacatacatgacaaacaagtttctgagaatgcttctgtctagtttttatgggaagatatttccttttcaccacagggccaaagcgcttctaatgtccacttccagatactacaaaaagagtgtttcaaacctgctccatgaaaggcaataatcaactccgtgacttgaatgcaaacatcacaaagacgtttctgagaatgcttctgtgtagattttatatgaagatattcccatttccaaaggaatcctcaaagatatccaaatatccatttgcagattctacaaaaggacgattttaaaactgctctatcaaaagaaagcttcaactctgttacttgagtacactcatgacaaacaagtttctgagaatgcttctgtctagtttttatttgaagatatttcctttctcaccataggcctgaaagcgcttgaaacgtccgcttgcagatactacagaaagagtgtttcaaacctgctctatgaaagggaatgttcaattctgtgacttgaatgcaaacatcacaaagaagttcctgagaatgcttctctctagattttatatgtaatcccgtttccaacgaaatcctcaaagctatccaaatatccactttcagattccacaaaaagagtgctttaaaactgctctgtaaaaagaaaggttcatctctgttagttgaatacacacatcacaaacaagtttctgagaatgcttctgtctggtttttatgggaagatatttcctttttcaacgtaagccacaaagcgcaacaaatgaccactttcagatactataaaaagagtgtttcaaactttctctatgaatgggaatgttcacctctgtgacttgaatgcaaacatcacaaagaagtttctgagaatgcttctgtgtagattttatttaagatattaccgtttccaacgaaatcctcaaagctatccaaatatccactagcagattctaccaaaagacggtttcaaaactgctctatcaaaagaaaggttcaaacctgttacttgagtacacacatcagaaacaagtttctgagaatgcttctgtctagtttttatgggaagatatttcctttttcaccataggccacaaagcgctccaaaagtcatctcaagatactacaaaaacagtgtttcaaacttgctctctgaaagggaatgttcaactctctgacttgaaagcaaacatccaaagatgtttctgagaatgcttctctctagattttataagaagatattcccttttccaaagaaatcctcaaagatatcgaaatatctacttgcaggttcttcaaaaagagtgtttcaaaactgctctatcaaaagaaagcttcaaatctgttagttgagtccacacatcacaaacaagtttttgagaatgcttctgtctagtttttatgggaagatatttcccttttcaccatagacctcaaagcactccaaatgtccggttccagataatacaaaaagagtttttcaaacctgctctatgaatgggaatgttcaaatatgtgacttgaatgcaaacatcatgaagaagtttctgagaatgcttctgtctatattttatacgaagacattcccgtttccaacgaaatcctcaaagctatcgaaatatccactggcaaattctacaaaaggagtgtttcaaaactgctatatcaatagaaaggttcaacactgtttcttgaggagatacagcataaacaagtttatgagattgcttctatctcgttttcatgggaagatacttcctttttcaccatagacctcaaagcactccaaatgtcctcttgcagatactacaaaaagagtgtttcaaacctgctctatgaaagggaatgttcaactctgtgattagaatgcaaacatcacaaagtagtttctgagaattcttctgtctggtttttatatgaagatattcccgtttccaatgaaatcctgaaagctatccaaatatacacttgcagattctacaaaaagtagtgttcaaaagtgctcagaagaaaggcagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctgtcaccgtgntcacgagatcctcaaaggtatctgaatatccagcttgcaggattctacaaaagagtgcttcagactgctctgctcaaaatgaaggttcatctctgttacttgagtactcacatcattagaaagattctgataatgcttctgtctggtttttaggagaagatatctcctttttcaccataggcttcaagcgctgccgatgtccacttccaaatattacaaaaagagtatttcaaaccagctctatgaaaggaagtgttcaactctatgagttgaatcgcaaacatcacagagaagtttctgagaaggcttctgtgttgattttatatgaagatattcgcctttccaacgaaatcttcaaagctatccaaatatccaccttcagatcctacaaaaagagtgtttccaaaatgctgtatcaaaacaaaggttcaactctattagttgagaacacacatcgcaaataagtttctgagaatgcctctgtctagtttttatttgaagatatttcctttttcaccacaggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctgaaagcgctgcaaatgtccacttccaggtagtgtacagagtgtttcaaacctgctctatgaaaggaagtgttcaactctatgagttgaatgcaaacatcacagagaagtttctgagaatgcttctgtcttgagtttatatggggatattcccgtttccaacgaaaccttcaaagctatccaaatatccacttgcagattctacaaaaagagtgtttccgaaatgttgtatccaaacaaaggttcaactcttttagttgagaacacacatggcaaataagtttctgagaatgcttctgtctagtttttatttgaagatatttcctttttcaccacaggcctgaaagcgcttcaaacgtccgcttgcagatactacagaaagagtgtttcaaacctgctctatgaaagggaatgttcagttctgtgacttgaatgcaaacatcacaaagaagttcctgagaatgcttctccctacattttatatgtaatcccgtttccaacgaattcctcaaagctatccaaatatccactttcggattccacaaaaagagtgtttcaaaactactctgtaaaaagaaaggttcatctctgttagttgaatacacacatcacaaacaagtttctgagaatgcttctgtctagtttttatgggaagatatttcctttttcatcatacgcctcaaagcgctgcaaatgtccacttccaaatattacaaaaagagtgtttcaaacctgctgtatgaagggaagtgttcatctctatgagttgaatgcaaacatcacagagaagcttctgagaatgcttctgtcttgattttatatgaagatattcccgtttccaatgaaaccttcaaagctatccaaatatccaattgcagattccacaaaaagagtgtttccaaaatgttgtatcaaaagaaaggttcaactctgttagttgaggatacacatcgcaaataagtttctgagaatgcttctgtctagtttttatttgaagatatttcctttctcaccataggcctgaaagcgtttgaaatgtccgtttgcagatactacagaaagagtgtttcaaacatgctctatgaaagggaatgttcagttctgtgacgtgaatgcaaacatcacaaagaagttcctgagaatgcttctccctagattttatatgtaatcccgtttccaacgaattcctcaaagctatccaaatatccactttaagattccacaaaaagagtgcttcaaaactactctgtaaaaagaaaggttcatctctgttagttgaatacacacatcacaaacaagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactgtgttagttgagaacacacatggcaaataagtttctgagaatgcttctgtctagattttatatgaagatatcccgtgtccaacgaaatcctcaaaggtatcaaaatatccacttgcagattctacaaaaagagtgcttcaaaactgctctgtcaaaatgaaggttcaactctgttacttgagtacacacatcacaagaaagattctgagaatgcttctgtctggtttttaggagaagatatctcctttttcaccataggcttcaaagcgctgccaatgtccacttccaaatattacaaaaagagtatttcaaaccagctctatgaaaggaagtgttcaactctatgagttgaatgcaagcatcacagagaagtttctgagaatgcttccgtctagattttatgtgaagatattcccgtttccaaggaaatcttcctagctatctaaatatcaacttgcagattctactaaaggagtgtttccaaagtgctgtatccggacaaaggttcaactatgttaattgaggacatacagcacaaagaagtttctgagaatgcttctgtctagattttatatgaagatatcccgtttccaaagaaatcctcaaagctatccaaatatctacatccagattctacaaaaagactgtttcaaaacggctctgtcaaaagtaaggttcaactctgttacttgagtacacacatcacaaggaagtttctgagaattcttctgtctggtttttaggagaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagactctactaaaggaatgtttccaaaatgctgtatccacacaaaggttcaactctgttaattgaggacatacagcacaaagaagtttctgagaatgcttctgtctagattttatatgaagatatcccgtgtccaacgaaatcctcaaaggtatcaaaatatccacttgcagattctacaaaaagagtgcttcaaaactgctctgtcaaaaggaaggttcaactctgttacttgagtacacacatcacaaggaagtttctgagaatgcttctgtctggtttttaggagaagatatttcgttcttcaacataggcctcaaagcgctgcaaatgtccacttccaaatattacaaaaagagtgtttcaaacctgctctatgaagggaagtgttcacctctatgagttgaatgtaaacatcacagagaagtttctgagaatgtttctgtcttgattttatatgaagatattccggtttccaacgaaaccttcaaagctatccaaatatccacttgcagatcctacaaaaagagtgtttccaaaacgttgtatccaaacaaaggttcaactcttttagttgagaacacacatcgcaaataagtttctgagaatgcttctgtctagtttttatttgaagatatttcctttttcaccacaggcctgaaagcgcttcaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctgcaaatgtccacttccaaatattacaaaaagagtgtttcaaacctgctgtatgaagggaagtgttcaactctatgagttgaatgcaaacatcacagagaagtttctgagaatgcttctgtcttgattttatatgcagatattcccgtttccaacgaaaccttcaaagctatccaaatatccacttgcagattctacaaaaaagtgtttccaaaatgttgtatcaaaacaaaggttcaactctgttagttgagaacacacatggcaaattagtttctgagaatgcttctgtctagtttttacttgaagatatttcctttctcaccataggcctgaaagcgcttcaaacgtccgtttgcagatactacagaaagagtgtttcaaacatgctctatgaaagggaatgttcagttctgtgacgtgaatgcacacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcacagagtgtttcaaacctgctctatgaaaggtagtgttcaactctatgagttgaatgcaaacatcacagagaagtttctgagaatgcttctgtcttgattttatatgaagatattcccgtttccaacgaaaccttcgaagctatccaaatatccacttgcagattctacaaaaagagtgtttccaaaatgttgtatccaaacaaaggttcaactctgttagttgagaacacacatcgcaaataagtttctgagaatgcttctgtctagtttttatttgaagatatttcctttttcaccacaggcctgaaagcgcttgaaacgacagcttgcagatactacagaaagagtgtttcaaacctgctctatgaaagggaatgttcagttctgtgacgtgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagactgtttcaaacctgctctatgaaaggaagtgttcaactccatgagttgaatgcaaacatcacagagaagtttctgagaatgcttctgtcttgattttatatgaagatattcccgtttccaacgaaaccttctaagctatccaaatatccacctgcagatcctacaaaaagagtgtttccaaaatgcagtatccaaacaaaggttcaactctgttagttgagaacacacatcgcaaatcagtttctgagaatgcttctgtctagtttttatttgaagatatttcctttttcaccacaggcctgaaagcgcttgaaacgtccgcttgcagatactacagaaagagtgtttcaaacctgctctatgaaagggaatgttcagttgtgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctgtgtaaaaagaaaggttcatctctgttagttgaatacacacatcacaaacaagtttctgagaatgcttctgtctagtttctatgggaagatatttcctttttcaacatacgcctcaaagcgctccaaatgtccacttccaggtagtgcacagagtgtttcaaacctgctctataatagggaacattctactctgtgacttgaatgaagacatcacaaagcagtttctgagaatgcttccgtcaagattttatatgaagatattcccgtttccaaggaaatctccctagctatctaaatatcaacttgcagattctactaaaggaatgtttccaaaatgctgtatccacacaagggttcaactctgttaattgaggacatacagcacaaagaagtttctgagaatgcttctgtctagattttttatgaagatatcccgtttccaaagaaatcctcaaaggtatccatatatctacttccagattctacaaaaagactttttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacctgcagatcctacaaaaagagtgtttccaaaatgctgtatcaaaacaaaggttcaactctgttagttgagaagacacatcgcaaataagtttctgagaatgcttctgtctagtttttatttgaagatatttcctttttcaccatatgcctgaaagcgcttgaaacgtccgcttgcaaatactacagaaatattgtttccaacatgctctatgaaaagtaatgttcatttctgtgattgaatgcaaacatcacaaagaagttcctgaaaatgcttctccctaaattttttatgtaatcccgtttccaaagaaatcctcaaaggtatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctgtaaatgtccacttccaaatattacaaaaagagtgtttcaaacctgctctatgaagggaagtgttcaactctatgagttgaatgcaaacatcactgagaagtttctgagaatgcttctgtcttgattttatatgaagatattcccgtttccaacgaaaccttcaaagctatccaaatatccacatgcagatcctacaaaaagagtgtttccaaaatgctgtatcaaaacaaaggttcaactctgttagttgagaacacacatcgcaaataagtttctgagaatgcttctgtctagtttttatttgaagatatttcctttttcaccacaggcctgaaagcgcttgaaacgtccgcttgcagatactacagaaagagagtttcaatcctactctatgaaagggaatgttcagttttgtgacttgaatgcaaacatcacaaagaagttcctgagaatgcttctccctagattttatatgtaatcccgtttccaacgaaatcctcaaagctatccaaatatccactttcagattccacaaaaagagtgttttaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcacagactgtttcaaacctgctctatgaaaggaagtgttcaactccatgagttgaatgcaaacatcacagagaagtttctgagaatgcttctgtcttgattttatatgaagatattcccgtttccaacgaaaccttctaagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttttcaccacaggcctgaatgcgcttgaaacgtccgattgcagatactacagaaagagtgtttcaaacctgctctatgaaagggaatgttcagttctgtgacttgaatgcaaacatcacaaagaagttcctgagaatgcttctccctagattttatatgtcatcccgtttccaacgaaatcctcaaagctatccaaatatccactttcagattccacaaaaagagtgtttcgaaactgctctgtaaaaagaaaggttcatctctgttagttgaatacacacatcacaaacaagtttctgagaatgcttctgtctagtttttatgggaaaatatttcctttttcaacataggcctcaaagcgctccaaatgtccacttccaggtagtgcagaaagagtgtttcaaacatgctctataaaagggaatattcaactctgtgacttgaatgcaaacatcacaaagcattttctgagaatgcttccttccagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccatagggctgaaagcgcttgaaatgtccgcttgcagatactacaaaaagagagtttcaaacgtgctctaagaaagggaatgttcagctctgtgatttgagtgcaaacatcacaaagaagtttctgagaatgcttctgtctggtttttaggagaagatattacctttttcaacataggcctcaaagcgctgcaaatgcccacttccaaatattacaaaaagagtgtttcaaacctgctctatgaagggaagtgttcaaatctatgagttgaatgcaaaaatcacagagaagtttctgagaatgcttctgtcttgattttatatgaagatattcccgtttccaacgaaaccttcaaagctatccaaatatccacctgcagattctacaaaaagagtgtttccaaaatgttgtatcaaaacaaaggttcaactctgttagttgaggacacacatcgcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttttgtgacttgaatgcaaacatcacaaagaagttcctgagaatgcttctctctagattttatatgtaatcccgtttccaacgaaatcctcaaagctatccacatatccactttcagattcaacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacatgctctataaaagggaatattcaactctgtgacttgaatgcaaacatcacaaagcactttctgagaatgcttccttccagattttatatgaagatattcccgtttccaaggaaatcttcctagctatctaaatatcaacttgcagattctactaaaggaatgtttccaaaatgctgtatccacacaaaggttcaactctgttaattgaggacatacagcagaaagaagtttctgagaatgcttctgtctagattttatatgaagatatgccgtttccaaagaaatcctcgaaggtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagagctgcaaatgtccacttccaaatattacaaaaagagtgtttcaaatctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttacttgaagatatttcctttcttaccataggcctgaaagcgcttgaaatgtccgtttgcagatactacagaaagagtgtttcaaacatgctctatgaaagggaatgttcagttctgtgacgtgaatgcaaacatctcaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccagatagtgcagaaagagtgtctcaatcctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttccaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggtatgtttccaaaatgctgtatccacacaaaggttcaactctgttaattgaggacatacagcacaaagaagtttctgagaatgcttctgtctagattttatatgaagatatcccgtttccaaacaaatcctcaaaggtatccaaatatctacttccagatcctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagagctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacttgaatgcaaacatcacaaagaagttcctggaatgcttctctctagatcttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcacagactgtttcaaacctgctctatgaaaggaagtgttcaactccatgagttgaatgcaaacatcacagagaagtttctgagaatgcttctgtcttgattttatatgaagatattcccgtttccaacgaaaccttctaagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttttcaccacaggcctgaatgcgcttgaaacgtccgattgcagatactacagaaagagtgtttcaaacctgctctatgaaagggaatgttcagttctgtgacttgaatgcaaacatcacaaagaagttcctgagaatgcttctccctagattttatatgtcatcccgtttccaacgaaatcctcaaagctatccaaatatccactttcagattccacaaaaagagtgtttcgaaactgctctgtaaaaagaaaggttcatctgtgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgaatgaagacatcacaaagcagtttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagagtgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcactgagaagtttctgagaatgcttctgtcttgattttatatgaagatattcccgtttccaacgaaaccttcaaagctatccaaatatccacatgcagatcctacaaaaagagtgtttccaaaatgctgtatcaaaacaaaggttcaactctgttagttgagaacacacatcgcaaataagtttctgagaatgcttctgtctagtttttatttgaagatatttcctttttcaccacaggcctgaaagcgcttgaaacgtccgcttgcagatactacagaaagagtgtttcaatcctactctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtcttgtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagttattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttttcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttccctctagattttatatgtaatcccgtttccaacgaaatcctcaaagctatccaaatatccactttcagattccacaaaaagagtgtttcaaaactgctctgtaaaatgaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctctgacttgaatgcaaacatcacaaagcactttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagaaaggttcaactctgttacttgagaacacacatcgcaaataagtttctgagaatgcttctgtctagtttttatttgaagatatttcctttttcaccacaggcctgaaagcgcttgaaacgtccgctttcagatactacagaaagagtgtttcaaacctgctctatgaaagggaatgttcagttctgtgacttcaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacatacgcctcaaagcgctccaaatgtcaacttccaggtagtgcacagagtgtttcaaacctgctctatgaaaggaagtgttcaactctatgagttgaatgcaagcatcacagagaagtttctgagaatgcttccgtctagattttatgtgaagatattcccgtttccaaggaaatcttcctagctatctaaatatcaacttgcagattctactaaaggagtgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaattcttctgtctggtttataggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccgaatatccacctgcagattctacaaaaagagtgtttccaaaatgctgtatcaaaacaaaggttcaactctgttagttgagaacacacatggcaaatatgtttctgagaatgcttctgtgtagtttttacttgaagatatttcctttctcaccataggcctgaaagctcttgaaacgtcagcttgcagatactacagaaagagtgtttcaaacctgctctatgaaagggaatgttcagttctgtgacttgaatgcaaacatcacaaagaagttcctgagaatgcttctctctaggttttatatgtaatcccgtttccaacgaaatcctcaaagctatccaaatatccactttcagattccacaaaaagagtgtttcaaaactgctctgtaaaaagaaaggttcatctctgttagttgaatacacgcatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccggctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtgtccaacgaaatcctcaaaggtatcaaaatatccacttgcagattctacaaaaagagtgcttcaaaactgctctgtcaaaaggaaggttcaactctgttacttgagtacacacatcacaaggaagtttctgagaatgcttctgtctggtttttaggagaagatatatcctttttcaacataggcctcaaagcgctgccaatgtccacttccaaatattacaaaaagagtgtttcaaatctgctgtatgaagggaagtgttcaactctatgagttgaatgcaaacatcacagagaagtttctgagaattcttctgtcttgattttatatgaagatattcccgttaacaacgaaaccttcaaagctatccaaatatccacttgcagattctacaaaaagagtgtttccaaaatgttgtatccaaacaaaggttcaactctgttagttgagaacacacatcacaaataagtttctgagagtgcttctgtctagtttttatttgaagatatttcctttttcaccacaggcctgaaagcgcttgaaacgtcagcttgcagatactacagaaagagtgtttcaaacctgcactatgaaagggaatgttcagttctgtgacttgaatgcaaacatcacaaagaagttcctgagaatgcttctccctagattttatatgtaatcccgtttccaacgaaatcctcaaagctatccaaatatccaatttcagattccacaaaaagagtgtttcaaaactactctgtaaaaagaaaggttcatctctgttagttgaataaacacatcacaaacaagtttctgagaatgcttctgtctagtttctatgggaagatatttcctttttcaacataggcttcaaagcgctccaaatgtccacttccaggtagtgcacagagtgtttcaaacctgctctataaaagggaacattctactctgtgacttgaatgaagacatcacaaagcagtttctgagaatgcttccgtctagattttatatgaagatattcccttttccaaggaaatcttattagctatctaaatatcaacttgcagattctactaaaggaatgtttccaaaatgctgtatccacacaaaggttcaactctgttaattgaggacatacagcacaaagaagttcctgagaatgcttctgtctagattttatatgaagatatcccgtttccaaagaaatcctcaaaggtatccaaatatctagttccagattctacaaaaagactgtttcaaaacggctctgtcaaaagtaaagttcaactctgttacttgagtacacacatcacaaggaagtttctgagaatgcttctgtctggtttttaggagaagatatttcgtttttcaacataggcctcaaagcgctgcaaatgtccacttccaaatattacaaaaagagtgtttcaaacctgctgtatgaaaggaagtgttcaactctatgagttcaatgcaaacatcacagagaagtttctgagaaggcttctgtgttgattttatatgaagatattcccgtttccaatgaaaccttcaaagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttttcaccacaggcctgaaagcgcttgaaacgtccgcttgcagatactacagaaagagtgtttcaaacctgctctatgaaagggaatgttcagttctgtgacttgaatgcaaacatcacacagaagttcctgagaatgcttctccctagattttatatgtaatcccgtttccaacgaaatcctcaaaactatccaattatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcactgagtgtttcaaacctgctctataaaagggaacattctactctgtgacttgaatgaagacttcacaaagcagtttctgagaatgcttccgtctagattttatgtgaagatattcccgtttccaaggaaatcttcctagctatctatatatcaactagcagattctactaaaggagtgtttccaaagtgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactctgttacttgagtacccacatcacaaggaagtttctgagaatgcttctgtctggtttttaggagaagatatttcctttttcaacataggcctcaaagcgctgcaaatgtccacttccaaatattacaaaaagagtgtttcaaacctgctgtatgaagggaagtgttcaactctatgagttgaatgcaaacattacagagaagtttctgagaatgcttctgtcttgattttatatgaagatattcccgtttccaacgaaaccttcaaagccatccaaatatccacttgcagattctacaaaaagagtgtttccaaaatgttgtaccaaaagaaaggttcaactctgttagttgaggacacacatcgcaaataagtttctgagaatgcttctgtctagtttttatttgaagatatttcctttctcaccataggcctgaaagcgtttgaaatatccgtttgcagatactacagaaagagtgtttcaaacatgctctatgaaagggaatgttcagttctgtgacttgaatgcaaacatcacaaagatgttcctgagaatgcttctctctagattttacatgtaatcccgtttccaacgaaatcctcaaagctaaccaaatatccactttcagattccacaaaaagagtgtttgaaaactgctctgtaaaaagaaaggttcatctctgttagttgaatacacacatcacaaacaagtttctgagaatgcttctgtctagtgtttatgggaagatatttcctttttcatcataggcctcaaagcgctccaaatgtgcacttccaggtagtgcagaaagtgtgtctcaaacctggtatataacagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgaggacacacatggcaaataagtttctgagaatgcttctgtctactttttacttgaagatatttcctttctcaccataggcctgaaagcgtttgaaatgtccgtttgcagatactacagaaagagtgtttcaaacatgctctatgaaagggaatgttcagttctgtgacgtgaatgcaaacatcacaaagaagttcctgagaatgcttctctctagattttgtatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagttttttgggaagatatttcctttttcatcataggcctcaaagcgctccaaatgcccacttccaggtagtgcagaaagagtgtctcaaacctggtatataacagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaataccgtatcaaaacaaagcttcaactctgttagttgagaacacacatggcaaataagtttctgagaatgcttctgtctagtttttacttgaagatatttcctttctcaccataggcctgaaagcgcttgaaacgtcagcttgcagatactacagaaagagtgtttcaaacctgctctatgaaagggaatgttcagttctgtgacttgaatgcaaacttcacaaagaagttcctgagactgcttctctctaggttgtatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttccgcataggcctcaaagcgctccaaatgtccacttgcatgtagtgcacagagtgtttcaaacctgctctataaaagggaacattctcctctgtgacatgaatgaaaacatctcaaagcagtttctgagaatgcttctgtctagattttatatgaagatatcccgtgtccaacgaaatcctcaaaggtatcaaaatatccacttgcagattctacaaaaagagagcttcaaaactgctctgtcaaaaggaaggttcatctctgttacttgagtacacacatcacaaggaagattctgagaatgcttctgtctggtttttaggagaagatatctcctttttcaccataggtctcaaaccgctgcaaatgtccacttctaaatattacaaaaagagtatttcaaaccagctctatgaaaggaagtgttcaactctatgagttgaatgcaaacatcacagagaagtttctgagaatgcttctgtcttgattttatatgaagatattcccatttccaacgaaacctttaaagctatccaaatatccacctgcagatcctacaaaaatactgtttccaaaatgctgtatcaaaacaaaggttcaactctgttagttggaaacacacatcgcaaataagtttctgagaatacttctgtctagtttttatttgaagatatttccttttgcaccacaggcctgaaagcgcttgaaacgtcagcttgcagatactacagaaagagtgtttcaaacctgcactatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcgtcaaagcgctccaaatgtccacttccaggtagtgcactgagtgtttcaaacctgctctataaaagggaacattctactctgtgacttcaatgaagacatcacaaagcagtttctgagaatgcttccgtctagattttatgtgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatattcccgtttccaaggaaatcttcctatctaagtatcaacttgcagattctactaaaggagtgtttccaaaatgctttatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgttccaaaacggctctgtcaaaagtaaggttcaactctgttacttgagtacacacatcacaaggaagtttctgagaatgcttctgtctggtttttaggagaagatatttcctttttcaacataggcttcaaagcgctgccaatgtccacttccaaatattacaaaaagagtatttcaaaccagctctatgaaaggaagtgttcaactctatgagttgaatgcaaacatcgcagagaagtttctgagaatgcttctgtgttgattttatatgaagatattcccgtttccaacgaaaccttcaaacctatccaaatatccacctgcagatcctacaaaaagagtgtttccaaaatgctgtatcaaaacaaaggttcaactttgttagttgaggacacacatcgcaaataagtttctgagaatgcttctgtctagtttttatttgaagatatttcctttctcaccataggcctgaaagcgtatgaaatgtccgtttgcaaatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtgaaaagaaaggttcatctctgttagttgaatacacacatcacaaacaagtttctgagaatgcttctgtctagtttttatgggaagatatttcctttttcagcataggcctcaaagcgctccaaatgtccacttccaggtagtgcagaaagagtgtcccaaacctggtatataacagggaacattctactctgtgacttgaatgaaaacatcacaaagcactttctgagaatgcttccgtctagattttatatgaagatattcccgtttccaaggaaatcttcctagctatctaaatatcaacttgcagattctactaaaggaatgtttccaaaatgctgtatcgaaacaaaggctcaactctgttaattgaggacatacagcacaaagaagtttctgagaatgcttctgtctagattttatatgaagatatcccgtgtccaaagaaatcctcaaaggtatcaaaatatccacttgcagattctacaaaaagagtgcttcaaaactgctctgtcaaaatgaaggttcaactctgttacttgagtacacacatcacaagaaagattctgagaatgcttctgtctggtttttaggagaagatatctcctttttcaccataggcttcaaagcgctgccaatgtccacttccaaatattacaaaaagagtatttcaaaccagctctatgaaaggaagtgttcaactctatgagttgaatgcaagcatcacagagaagtttctgagaatgcttccgtctagattttatgtgaagatattcccgtttccaaggaaatcttcctagctatctaaatatcaacttgcagattctactaaaggagtgtttccaaagtgctgtatccacacaaaggttcaactctgttaattgaggacatacggcacaaagaagtttctgagaatgcttctgtctagattttatatgaagatatcccgtttccaaagaaatcctcaaagctatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctccaaatgtccacttccaggtagtgcagaaagagtgtttcaaacctgctctataaaagagaatattcaactcagtgacttgaatgcaaacatcacaaagcactttctgagaatgcttccgtctagattttatatgaagatattcccgtttccaaggaaatcttcctagctatctaaatatcaacttgcagattctactaaaggaatgtttccaaaatgctgtatccacacaaatgttcaactctgttaattgaggacatacagcacaaagaagtttctgagaatgcttctgtctagattttatatgaagatatcccgtgtccaacgaaatcctcaaaggtatcaaaatatccacttgcagattctacaaaaagagtgcttcaaaactgatctgtcaaaaggaaggttcaactctgttacttgagtacacatatcacaaggaagtttccgagaatgcttctgtctggtttttaggagaagatatttcctttttcaacataggcctcaaagcgctgcaaatgtccacttccaaatattacaaaaagagtgtttcaaacctgctgtatgaagggaagtgtacaactctatgagttgaatgcaaacatcacagagaagtttctgagaatgcttctgtcttgattttatatgaagatattcccgtttccaacgaaaccttcaaagctatccaaatatccactagcagattctacaaaaagagtgtttccaaaatgttgtataaagacaaaggttcaactctgttagttgagaacacacatcgcaaataagtttctgagaatgcttctgtctaatttttatttgaagatatttcctttttcaccacaggcctgaaagcgcttcaaacgtccgcttgcagatactacagacagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcacagagtgtttcaaacctgctctatgaaaggaagtgttcaactctatgagttgaatgcaaacatcacagagaagtttccgagaatgcttctgtcttgattttatatgaggatattcccgtttccaacgaaaccttcaaagctatccaaatatccaccggcagatcctacaaaaagagtgttgccaaaatgccgtatcaaaacaaaggttcaattctgttagttgagaacacacatggcaaataagtttctgagaatgcttctgtctagtttttacttgaagatttttcctttcacaccataggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaatctatccaaatatccactttcagattccacaaaaagattgtttcaaaactgctctgtaaaaagaaaggttcatctctgttagttgaatacacacatcacaaacaagtttctgagaatgcttctgtctagtttttatgggaagatatttcctttttcaacacaggcctcaaagcgctccaaatgtccacttccaggtagtgcactgagtgtttcaaacctgctctataaaagggaacattctactctgtgacttgaatgaagacatcacaaagcagtttctgagaatgcttccgtctagattttatgtgaagatattcccgtttccaaggaaaacttcctagctatctaaatatcaacttgcagattctactaaaggagtttttccaaaatgctgtatccacacaaaggttcaacactgttaattgaggacatacagcacaaagaagtttctgagaatgcttctgtctagattttatgtgaagatatcccgtgtccaacgaaatcctcaaaggtatcaaaatatccacttgtagattctgcaaaaagagtgcttcaaaactgctctgtcaaaatgaaggttcaactctgttacttgagtacacacatcacaagaaagattctgagaatacttctgtctggtttttaggagaagatatctcctttttcaccataggcttcaaagcgctgccaatgtccacttccaaatattacaaaaacagtatttcaaaccagctctatgaaaggaagtgttcaactctatgagttgaatgcaaacatcacagagaagtttctgagaatgcttctgtgttgattttatatgaagatattcccgtttccaacgaaaccttcaaagctatccaaatatccacctgcagatcctacaaaaagagtgtttccaaaatgctgtatcaaaacaaaggttcaactctgttagttgagaacacacatcgcaaataagtttctgtgaatgcttctgtctagtttttatttgaagatatttcctttttcaccacaggcctgaaagcgcttgaaacgtccgcttgcagatactacagaaagagtgtttcaaagctgctctatgaaagggaatgttcagttctgtgacttgaatgcaaacatcacaaagaagatcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtcctcttccaggtagtgcacagagagtttcaaacctgctctatgaaaggaagtgtgcaactctatgagttgaatgcaagcatcacagagaagtttctgagaatgcttccgtctagattttatgtgaagatattcccgtttccaaggaaatcttcctagttatctaaatatcaacttgcagattctactaaaggagtgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggtttttaggtgaagatatttcctttttcaacataggcctcaaagcgctgcaaatgtccacttccaaatattacaaaaagagtgtttcaaacctgctgtatgaagggaagtgttcaactctatgagttgaatgcaaacatcacagagaagtttctgagaatgtttctgtcttgattttatatgaagatattcccgtttccaacgaaaccttcaaagctatccaaatatccacttgcagattccacaaaaagagtgtttccaaaatgttgtatcaaaagaaaggttcaactctgttagttgaggacacacatcacaaataagtttatgagaatgcttctgtctagtttttatttgaagatatttcctttctcaccataggcctgaaagcgtttgagatgtccgtttgcagatactacagaaagagtgtttcaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttacttgaatacacacatcacaaacaagtttctgagaatgcttctgtctagtttttatgggaagatatttcctttttcagcataggcctcaaagcgctccaaatgtccacttccaggtagtgcagaaagagtgtctcaaacctggtatataacagggaacattctactctgtgacttgaatgaaaacatcacaaagcagtttctgagaatgcttccgtctagattatatatgaagatattcccgtttccaacgaaaccttcaaagctatctgaatatccacctgcagattctacaaaaagagtgtttccaaatgccgtatcaaaacaaaggttcaactctgttagttgagaacacacatggcaaataagtttctgagaatgcttctgtctagtttttcttgaagatatttcctttctcaccataggcctgaaagcgcttgaaacgtcagcttgcagatactacagaaagactgtttcaaacctgctctatgaaagcgaatgttcagttctgtgacttgaatgcaaacatcacaaagaagttcctgagaatgcttctccctagattttatatgtaatcccgtttccaacgaaattttcaaagctgtccaaatatccactttcagattccacaaaaagagtgtttcaaaactgctctgtaaaaagaaaggttcatctctgttagttgaatatacacatcacaaataagtttctgagaatgcttctgtctagtttctatgggaagatattttctttttcaacataggcctcaaagcgctccaaatgtccacttccaggtagtgcacagagtgtttcaaacctgctctataaaagggaacattctactctgtgacttgaatgaagacatcacaaagcagtttctgagaatgcttccgtctagattttatatgaagatattcccgtttccaaggaaatcttcctagctatctaaatatcaaattgcagattctactaaaggaatgtttccaaaatgctgtatccacacaaaggttcaactctgttaattgaggacatacagcacaaagaagtttctgagaatgcttctgtctagattttatatgaagatatcccgtgtccaacgaaatcctcaaaggtaacaaaatatccacttgcagattctacaaaaagagtgcttcaaaactgctctgtcaaaaggaaggttcaactctgttacttgagtacacacatcacaaggaagtttctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcattcaaaaattaatttagccactactatatagtgctgaagacagaaatggtatcagacttcatgcatcttctacaatataaaaatgcctagagacatgttcagttaaaaagagagaagatatacacactacatgtagatatagaagtttgcccacatgcacatgtgtctgtagtgtgcatgtatgggtgtatatgtgtatgtgtgcctatagtgagaatgtgtatatctgtgctgatattctgcacttcccctctccatgaccctccccaaatccactctccactcttctccaactgctttgtgccctaaatgactgaactatatgaattacatcaatggatttcctcatcctctagcttcttgttgggttcagacaatgagtggaacgccagaagaaaatcagaaggcagcaaataagatatatcagagtatttatttctctgagtctccttgcaaagtcactatgactcatcatatcctcaactaaaaatcacagttcctatcaagcaatccatctttctctgcaggttccagttgctgctctctctccttgtcccttcggtagtgacggcaccttgctctgactatctcctggggtactacttcactaaccctgtggtttccctgtaccctgcccatatcttgtaaattatgcctttattaaactcttctcaggttacataatttgacagtgccatctgtttacagcaggaaccttgatgtatacattacgccccaacaacttacaacgattaatagtatttttctagtcttactgcaacattccaggctttagaaaattgtatttccttggtaataatctaggtatatcagactgcaaggtcttcaagagcagagatcataccatacacacagttgtaacatttgcaggcataaatagctcctgctgctcacagttggcaatcaacaattattctgaggaattgaattgacctaaaacaaaacatagctattcccaggctatgatcttgaatgaacaaaataaacattatcttaatcacgacgttaaaaaaaatcatgtgatcctatttactgatgttaacttgctgaacataatacccatttaatgtcttcttcatgcagaaataaatggtgtttaagagtattggccaggcaccatggctcatgcctgtaatcccagcactttgggaggccaaggtgggtggatcacttaaagtcaagagtttgagaccagcctggccaacatggtgaaacccccttcttactaaaaatacaaaaactagccaggcgtggtggtgggcgcctgtaagcccagctactntggaggctgaggcaggagaactgcttgaacccggggggtggagtttgcagtgagccgagattgtgccactgcactctaccctgggcgacagagagagactccatctcaaaagaaaaaagaaatattctacagctggctgtgtaattacattaatcaaagagtgcttcttctgttggtttctttgcagttgccatagtagcaaccacatgttttcaagtagagagcacacatagaacccatccttaattacacgtgtagcactacatttcagagaacacaataaatatggaggtcatgagtgcatggaaaagaagtatgatgacaaaagatttgctctccagcttttctatcttttgattattcctaacccctttattagtatgttctgattccctattatcccttttcattcactgcagtataaaggtctctgcacccacccacccaattacaaacatctgctactaaaatgacccagaactgtcctttaaaaaaagtcgggaggaaaattgaagtttctgccgagaacgaaaagatgacgaatggaaatgaaaagtgatctactgaatgactttttcgaagaaaaaactgaacgaccgaccccacggcttctttttctcagtgattgatggcggagagacgttcgaaggttcttccctttntgaaggtagccctttggtgtacgagagggtctctgatttgtgaatcgagacccagccgtgatgaatacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttcctttttcaacatacgcctcaaagcgctccaaatgtccacttccaggtagtgcacagagtgtttcaaacctgctctatgaaaggaagtgttcaactctatgagttgaatgcaagcatcacagagaagtttctgagaatgcttccgtctagattttatgtgaagatattcccgtttccaaggaaatcttcctagctatctaaatatcaacttgctgattctactaacggagtgtttccttaatgctgtattcacacaaaggtgcatctctgtgaatcggggacatacagcacatagcagagtgcggtaatgaatccgtctttttgtagaatctggaagtagatatttggatacctttgaggatttctttggaaacgggatatcttcatataaaatctagacagaagcattctcagaaacttctttgtgctgtatgtcctcaattaacagagttgaacctttgtgtggatacagcattttggaaacactcctttagtagaatctgcaagttgatatttagatagctaggaagatttccttggaaacgggaatatcttcacataaaatctagacggaagcattctcagaaacttctctgtgatgcttgcattcaactcatagagttgaacacttcctttcatagagcaggtttgaaacactctgtgcactacctggaagtggacatttggagcgctttgaggcgtatgttgaaaaaggaaatatcttcccataaaaactagacagaagcattctcagaaacttgtttgtgatgtgtgtattcaactaacagagatgaacctttctttttacagagcagttttgaaacactctttttgtggaatctgaaagtggatatttggatagctttgaggatttcgttggaaacgggattacatataaaatctagggagaagcattctcaggaacttctttgtgatgtttgcattgaagtcacagaactgaacattccctttcatagagcaggtttgaaacactctttctgtagtatctgaaagcggacgtttcaagcgctttcaggcctgtggtgaaaagggaaatatcttaaaataaaaactagacagaagcattctcagaaacttatttgcgatgtgtgttctcaactaacagagttgaacctttgttttgatacagcattttggaaacactctttttgtaggatctgcaggtggatatttggatagatttgaaggtttcgttggaaacgggaatatcttcatataaaatcaacacagaagcattctcagaaacttctctgtgatgtttgcattcaactcatagagttgaacacttcctttcatagagctggtttgaaatactctttttgtaatatttggaagtggacatttgcagcgctttgaagcctatggtgaaaaaggagatatcttcccctaaaaaccagacagaagcattctcagaatctttcttgtgatgtgtgtactcaagtaacggagttgaaccttcattttgacagagcagttttgaagcactctttttgtagaatctacaagtggatattttgatacctttgaggatttcgttggacacgggatatcttcatataaaatctagacagaagcattctcagaaacttctttgtgctgtatgtcctcaattaacagagttgaacctttgtgtggatacagcattttggaaacattcctttagtagaatctgcaagttgatatttagatagctaggaagatttccttggaaacgggaatatcttcacataaaatctagacggaagcattctcagaaactgctttgtgatgtcttcattcaagtcacagactagaatgttcccttttatagagcaggtttgaaacactcagtgcactacctggaagtggacatttggagcgctttgacgcctatgttgaaaaaggaaatatcttcccatagaaactagacagaagcattctcagaaacttgtttgtgatgtgtgtattcaactaacagagatgaacctttctttttacagagcagttttgaaacactctttttgtggaatctgaaagtggatatttggatagctttgaggatttcgttggaaacgggattacatataaaatctagggagaagcattctcaggaacttctttgtgatgtttgcattcacgtcacagaactgaacattccctttcatagagcaggtttgaaacactctttctgtagtatctgcaagctgacgtttcaagcgctttcaggcctgtggtgaaaaaggaaatatcttcaaataaaaactagacagaagcattctcagaaacttatttgcgatgtgtgttctcaactaacagtgttgaacctttgtttggatacaacattttggaaacactctttttgtagaatctgcaagtggatatttggatagcttcgaaggtttcgttggaaacgggaatatcttcatataaaatcaagacagaagcattctcagaaacttctctgtgatgtttgcattcaactcatagagttgaacactacctttcatagagcaggtttgaaacactctgtgcactacctggaagtggacatttggagcgctttgaggcctatgttgaaaaaggaaatatcttcccataaaaactagacagaagcattctcagaaacttgtttgtgatgtgtgtattcaactaacagagatgaacctttctttttacagagcagttttgaaacactctttttgtggaatccgaaagtggatatttggatagctttgaggatttcgttggaaacgggattacatataaaatctagagagaagcattctcaggaacttctttgtgatgtgtgcattcacgtcacagaactgaacatcccttaggtcgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctgaagcttcttggaatttctttctctcccattaatctagtatgatctctcaggcatatttatttaaagttcttcctctcactattcccttcttcaccatcatgcctaggttagttacaaagaactaatttaatgacccatttattctgaagggaggcacaagaagtgaagcttctttctgaggcctgaagggatctcacctccttaaatctctgttttcctacccctacttcagatgttattgagacattatattttcttcctctaccttcagaaacttcagtatcaacaggtccagatctgcctaagccctcagatgagtctgcaaacaatcattgtgtcaacatttgactcatgccttgcagatgatcccaggcaccgctgtcttaacctgtgaaaactgcaaattcttggcacaaacaacttcttctgcacatccctcctcctcatacatacagtaagggacttggccaaattccaacacagcctctatcagctcggagccacgtccctacgatgccccatacccctctaaagcacctgcctgggaacattcaattctgccaaaagaatttactgtttgtcccacccaaaacttgactataggcccctgacctcccatttctaagagccttaactttagaaaacttgcaattatggccaggncgtggtggctcaaatcccatcactttcagaggctgaggagggtggaatcttgaggtcaagagagcaagaccatcctggccaacatggtgaaaccccgtctctactaaaaatacaaaaattagctgggcatggtggcacacacatgtagtcctggctacttgggaggctgaggcaggagaatgacttcaacctgggaggtggaggttacagtgagccgagatcacgccactacactccagcctgggcaacaagaaggaaactctgtcaaaaagaaaataaagtgtgccgttatgagaatcattttggctaaggggtgttggtttgaatggtggtattgctaaggagactgatgctaaaggcactcttagtaagtgcaactgtcgctgaggttgatgttccaaaaggcactgatgttaaggacattgttgctaagcctgttttttaaagtgtgctgctgttatgggtattgttgttaagggtgttgtaagagaaatcattgctgagtaccactgctgctgagagcattgccactaagatctaatattgccaaggacagtgttgctaaggccgttgaacttaaatgcattttagtaaaggcattgttcctaaggctattgttaggggctgttgcgaaggaactgtgttaaagatattattgttatagtcgttaaatctaagagttttgatgttaagggccctgatgctaaaaacacgtttagataatttttactacaactcattatggctaagaatgttgatgttaggtacattattgcaaggcactttagtaaagtgtcttgttgctaaatgattattgctaaaggcactgttgctaaggggactgtttcttagtgaatccataagagctttgttgctaagggccatttttgctaagaacattgtttctaagggtgttgaagttaaacacgttattactgaaagcactgtggtaaaggcatcttacctaagggtttactgctaatagcactgttactcaaggaactgaggctaagggcattgttgctgagggggttgttattaagggcatttgttatgaaaggtcattgtgtctaagtacaattgcttctaaggacattgtttgaagggcattatttcaagggtcattgttgctaagagcattaatgtcaccgacagtgttgttcctaagggaatgttagtaagagcattgtttctaagagtattgttacaaaaggactcttgctaaggacattgttgcaaatacattttggtaaaggcattgttcctaaagggattctggctaaggacactgttacaaggggcatcttttataagggcattgttgctaaagttgattttactaaaggccattttagctaaaggcactgttgctaagtacactgttgtcaaggatgttgttgctaagggtgctgttgttaagagccattatgttctaaaggatccgttgccaagggaattgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagatattcccgttcccaaggaaatcttcctagctatctaaatatcaacttgcagattctaccaaaggaatgtttccaaaatgctgtatccacacaaagcttcaactctgttaattgaggacatacagcacaaagaagtttctgagaatgctccagtctagattttttatgaagatatcccgtttccaaagaaatcctcaaaggtatccaaatatctacttccagattctacaaaaagactttttcaaaacggctctgtcaaaagtaaggttcaactctgttacttgagtacacacatcacaaggaactttctgagaatgcttctgtctggtttttaggagaagatatttccttttccaacataggcctcaaagcgctgcaaatgtccacttacaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttttcaccacaggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctatgaaaggaagtgttcaactccatgagttgaatgcaaacatcacagagaagtttctgagaatgcttctgtcttgatattatatgaagatattcccgtttccaacgaaaccttcaaagctatccaaatatccacttgcagattctacaaaaagagtgtttccgaaatgctgtatcaaaacaaaggttcaactctgttagttgagaacacacatggcaaataagtttctgagaatgcttctgtctagtttttatttgaagatatttcctttttcaccataggcctgaaagcgcttgaaacgtccgcttgcagatactacagaaagagtgtttcaaacatgctctatgaaagggaatgttcagttctgtgacttgaatgcatacatcacaaaaaagatcctgagaatgcttctctctagattttatatgtaatcccgtttccaacgaaatcctcaaagatatccaaatatccactttcagattccacaaaaagagtgtttcaaaactgctctgtaaaaagaaaggttcatctctgttagttgaatacacacatcacaaacaagtttctgagaatgcttctgtctagtttttatgggaggatatttcctttttcaacataggcctcaaagcgctccaaatgtccacttccaggtagtgcagaaagagtgtttcaaacctgctctataaaagggaatattcaactctgtgtcttgaatgcaaacatcacaaaacactttctgagaatgcttccgtctagattttatatgaagatattcccgtttccaacgaaatcttcctagctatctaaatatcaacttgcagattctactaaaggaatgtttccaaaatgctgtatcgaaacaaaggttcaactctgttaattgaggacatacatcacaaagaagtttctgagaatgcttctgtctagattttatatgaagatatcccgtgtccaacgaaatcctcaaaggtatcaaaatatccacttgcagattctacaaaaagagtgcttcaaaactgctctgtcaaaaggaaggttcaactctgttacttgactacacacatcacaagaaagattctgagaatgcttctgtctggtttttaggggaagatatctcttttttcaccataggcttcaaagcgctgccaatgtccacttccaaatattacaaaaagagtatttcaaaccacctctatgaaagaaagtgttcaactctatgagttgaatgcaaacatcacagagaagtttctgagaatgtttctgtcttgattttatatgaagatattcccgtttccaacgaaaccttcatagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttttcactacaggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatgctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgtgaagatatttcctttttcatcataggcctcaaagcgctccaaatgtccacttccaggtagtgcacagagtgtttcaaacctgctctataaaagggaacattctactctgtgacttgaatgaagacatcacaaagcattttctcagaatgcttccgtctagattttatatgaagatattcccgtttccaaggaaatcttcctagctatctaaatatcaacatgcagattctactaaaggaatgtttccaaaatgctgtatccacacaaaggttcaactctgttaattgaggacatacagcacaaagaagtttctgagaatgcttctgtctagattttgtatgaagatatcccgtttccaaagaaatcctcaaaggtatccaaatatctacttccagattctacaaaaagactttttcaaaacggctctgtcaaaagtaaggttcaactctgttacttgagtacacacatcacaaggaactttctgagaatgcttctgtctggtttttaggagaagatatttccttttccaacataggcctcaaagcgctgcaaatgtccacttacaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacctgcagattctacaaaaagagtgtttcctgtatcaaaacaaaggttcaaggctgttagttgaggacacacgtcgcaaataagtttctgagaatgcttctgtttagtttttatttgaagatatttcctttctcaccacaggcctgaaagcgcttgaaacgtccgcttgcagatactacagaaagagtgtttcaatcctactctatgaaagggaatgttcagttttgtgacttgaatgcaaacatcacaaagaagttcctgagaatgcttctccctagattttatatgtaatcccgtttccaacgaaatcctcaaagctatccaaatatccactttcagattccacaaaaagagtgtttcgaaactgctctgtaaaaagaaaggttcatctctgttagttgaatacacacatcacaaacaagtttctgagataacttctgtctagtttctatgggaagatatttcctttttcaacataggcctcaaagcgctccaaatgtccacttccaggtagtgcacagagtgtttcaaacctgctctataatagggaacattctactctgtgacttgaatgaagacatcacaaatcagtttctgagaatgcttccgtcaagattttatatgaagatattcccgtttccaaggaaatcttcctagctatctaaatatcaacttgcagattctactaaaggaatgtttccaaaatgctgtatccacacaaaggttcaactctgttaattgaggacatacagcaccaagaagtttctgagaatgcttctgtctagattttttatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaaaggaagtgttcaactctatgagttgaatgcaaacatcacagagaagtttctgagaatgcttctgtcttgattttatatgaagatattcccgtttccaacgaaaccttctaagctatccaaatatccacctgcagatcctacaaaaagagtgtttccaaaatgctgtatcaaaacaaaggttcaactctgttagttgagaacacacatggcaaataagtttctgagaatgcttctgtctagtttttatttgaagatatttcctttttcaccacaggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtcatcccgtttccaacgaaatcctcaaagctatccaaatatccactttcagattccacaaaaagagtgtttcaaaactgctctgtaaaaagaaaggttcatctgtgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctatgaaaggaagtgttcaactccatgagttgaatgcaaacatcacagagaagtttctgagaatgcttctgtcttgattttatatgaagatattcccgtttccaacgaaaccttctaagctatccaaatatccacctgcagatcctacaaaaagagtgtttccaaaatgctgtatcaaaacaaaggttcaactttgttagttgagaacacacatcgcaaatcagtttctgagaatgcttctgtctagtttttatttgaagatatttcctttttcaccacaggcctgaaagcgcttgaaacgtccgcttgcagatactacagaaagagtgtttcaaacctgctctatgaaagggaatgttcagttgtgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgattgaatacatcacaaagcagtttctgagaatgcttccgtctagattttatatgaagatattcccgtttccaaggaaatcttcctagctatctaaatatcaacttgcagattttactaaaggaatgtttccaaaatgctgtatccacacaaagcttcaactctgttaattgaggacatacagcacaaagaagtttctgagaatgcttctgtctagattttttatgaagatatcccgtttccgaagaaatcctcaaagttatccaaatatctacttccagattctacaaaaagactttttcaaaacggctctgtcaaaagtaaggttcaactctgttacttgagtacacacatcacaaggaactttctgagaatgcttctgtctggtttttaggagaagatatttccttttccaacataggcctcaaagcgctgcaaatgtccacttacaaatattacaaaaagagtgtttcaaacctgctctgtgaagggaagtgttcaactctatgagttgaatgcaaacatcacagagaagtttctgagaatgcttctgtcttgattttatatgaagatattcccgtttccaacgaaaccttcaaagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttctcaccataggcctgaaagcgcttgaaacgtccgcttgcagatactacagaaagagtgtttcaaacctgctctatgaaacggaatgttcagttctgtgacttgaatgcaaacatcacaaagaagttcctgagaatgcttctccctagattttttatgtaatcccgtttccaacgaaatcctcaaagctatccaaatatccactttcagattccacaaaaagagtgtttcaaaactgctctgtaaaaagaaagcttcatctctgttagttgaatacacacatcacaaacaagtttctgagaatgcttctgtctagtttttatgggaagatatttcctttttcaacataggcctcaaagcgctgtaaatgtccacttccaaatattacaaaaagagtgtttcaaacctgctctatgaagggaagtgttcaactctatgagttgaatgcaaacatcacagagaagtttctgacaatgcttctgtcttgattttatatgaagatattcccgtttccaacgaaaccttcaaagctatccaaatatccacatgcagatcctacaaaaagagtgtttccaaaatgctgtatcaaaacaaaggttcaactctgttagttgagaacacacatcgcaaataagcttctgagaatgcttctgtctagtttttatttgaagatatttcctttttcaacacaggcctgaaagcgcttgaaacgtccgcttgcagatactacagaaagagtgtttcaatcctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaagttcatctctgttagttgaatacacacatcacaaacaagtttctgagaatgcttctgtctagtttttatgggaagatatttcctttttcaacataggcctcaaagcgctccaaatgtccacttccaggtagtgcacagactgtttcaaacctgctctatgaaaggaagtgttcaactccatgagttgaatgcaaacatcacagagaagtttctgagaatgcttctgtcttgattttatatgaagatattcccgtttccaacgaaaccttctaagctatccaaatatccacctgcagatcctacaaaaagagtgtttccaaaatgcagtatccaaacaaaggttcaactctgttagttgagaacacacatcgcaaatcagtttctgagaatgcttctgtctagtttttatttgaagatatttcctttttcaccacaggcctgaaagcgcttgaaacgtccccttgcagatactacagaaagagtgtttcaaacctgctctatgaaagggaatgttcagttgtgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctgtgtaaaaagaaaggttcatctctgttagttgaatacacacatcacaaacaagtttctgagaatgcttctgtctagtttctatgggaagatatttcctttttcatcatacgcctcaaagcgctccaaatgtccacttccaggtagtgcacagagtgtttcaaacctgctctataatagggaacattctactctgtgacttgaatgaagacatcacaaagcagtttctgagaatgcttccgtcaagattttatatgaagatattcccgtttccaaggaaatcttcctagctatctaaatatcaacttgcagattctactaaaggaatgtttccaaaatgctgtatccacacaagggttcaactctgttaattgaggacatacagcacaaagaagtttctgagaatgcttctgtctagattttttatgaagatatcccgtttccaaagaaatcctcaaaggtatccatatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcatgattttatatgaagatattcccgtttccaacgaaaccttcaaagctatccaaatatccacctgcagatcctacaaaaagagtgtttccaaaatgctgtatcaaaacaaaggttcaactctgttagttgagaacacacatctcaaataagtttctgagaatgcttctgtctagtttttatttgaagatatttcctttttcaccacaggcctgaaagcgcttgaaacgtccgcttgcagatactacagatagagtgtttcaaacctgctctatgaaagggaatgttcagttctgtgacttgaatgcaaacatcacaaagaagttcctgagaatgcttctccctacattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggccacaaagcgctccaaatgtccacttccagatagtgcacaaagtgtgtctcaaacctggtatataaaagggaacattctactctgtgacttgaatgaaaacatcacaaaggagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgagacgtcctcttgcagatactacagaaagagtgtttcaaacctgctctatgaaagggaatgttcagttctgtgacttgaatgcaaacatcacaaagaagttcctgagaatgcttctctctaggttttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtgcacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgtagattctactaaaggaatgtttccaaaatgctgtatcgaaacaaaggttcaactctgttaattgaggacatacagcacaaagaagtttctgagaatgcttctgtctagattttatatgaagatatcccgtgtccaaagaaatcctcaaaggtatcaaaatatccacttgcagattctacaaaaagagtgcttcaaaactgctctgtcaaaaggaaggttcaactctgttacttgagtacacacatcacaagaaagattctgagaatgcttctgtctggtttttacgagaagatatcccctttttcaccataggcttcaaagcgctgccagtgtccacttccaaatattacaaaaagagtatttcaaaccagctctatgaaaggaagtgttcaactctatgagttgaatgcaaacatcacagagaagtttctgagaatgcttctgtgttgattttatatgaagatattcccgtttcctacgaaaccttcatagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttttcaccacaggcctgaaagcgcttgaaacgtccacttgcagatactacagaaagagtgtttcaaagctgctctatgaaagggaatgttcagttctgtgacttgaatgcaaacatcacaaagaagttcctgagaatgcttctccctagattgtatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaacgtccacttccaggtagtgcagaaagagtgtctcaaacctggtatataacagggaacattctactctgtgacttgaatgaaaacatcacaaagcagtttctgagaatgcttccgtctagattttatatgaagatattcccgtttccaacgaaatcttccaagctatctaaatatccacctgcagattctacaaaaagagtgtttccaaaatgccgtatccacacaaaggttcaactctgttaattgaggacatacagcacaaataagtttctgagaatgcttctgtctagattttatatgaagatatcccgtgtccaacgaaatcctcaaagctatcaaaatatccacttgcagattctacaaaaagagtgcttcaaaactgctctgtccaaaggaaggttcaactctgttacttgagtacacacatcacaaggaagtttctgagaatgcttctgtctgctttttaggagaagatatttcctttttcaacataggcctcaaagcgctggaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgagaacacacatcgcaaataagtttctgagaatgcttctgtctagtttttatttgaagatatttcctttctcaccataggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctgcaaatgtccacttccaggtagtgtacagagtgtttcaaacatgctctatgaaaggaagtgttcaactctatgagttgaatgcaaacatcacagagaagtttctgagaatgcttctgtcttgagtttatatggggtattcccgtttccaacgaaaccttcaaagctatccaaatatccacttgcagattctacaaaaagagtgtttccgaaatgttgtatccaaacaaaggttcaactcttttagttgagaacacacatggcaaataagtttctgagaatgcttctgtctagtttttatttgaagatatttcctttttcaccacaggcctgaaagcgcttcaaacgtccgcttgcagatactacagaaagagtgtttcaaacctgctctatgaaagggaatgttcagttctgtgacttgaatgcaaacatcacaaagaagttcctgagaatgcttctccctacattttatatgtaatcccgtttccaacgaattcctcaaacctatccaaatatccactttcggattccacaaaaagagtgtttcaaaactactctgtaaaaagaaaggttcatctctgttagttgaatacacacatcacaaacaagtttctgagaatgcttctgtctagtttttatgggaagatatttcctttttcatcataggcctcaaagcgctgcaaatgtccacttccaaatattacaaaaagagtgtttcaaacctgctgtatgaagggaagtgttcatctctatgagttgaatgcaaacatcacagagaagcttctgagaatgcttctgtcttgattttatatgaagatattcccgtttccaatgaaaccttcaaagctatccaaatatccaattgcagattccacaaaaagagtgtttccaaaatgttgtatcaaaagaaaggttcaactctgttagttgaggatacacatcgcaaataagtttctgagaatgcttctgtctagtttttatttgaagatatttcctttctcaccataggcctgaaagcgtttgaaatgtccgtttgcagatactacagaaagagtgtttcaaacatgctctatgaaagggaatgtccagttctgtgacgtgaatgcaaacatcacaaagaagttcctgagaatgcttctccctagattttatatgtaatcccgtttccaacgaattcctcaaagctatccaaatatccactttaagattccacaaaaagagtgtttcaaaactactctgtaaaaagaaaggttcatctctgttagttgaatacactcatcacaaacaagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactgtgttagttgagaacacacatggcaaataagtttctgagaatgcttctgtctagattttatatgaagatatcccgtgtccaacgaaatcctcaaaggtatcaaaatatccacttgcagattctacaaaaagagtgcttcaaaactgctctgtcaaaatgaaggttcaactctgttacttgagtacacacatcacaagaaagattctgagaatgcttctgtctggtttttaggagaagatatctcctttttcaccataggcttcaaagcgctgccaatgtccacttccaaatattacaaaaagagtatttcaaaccagctctatgaaaggaagtgttcaactctatgagttgaatgcaagcatcacagagaagtttctgagaatgcttccgtctagattttatgtgaagatattcccgtttccaaggaaatcttcctagctatctaaatatcaacttgcagattctactaaaggagtgtttccaaagtgctgtatccggacaaaggttcaactatgttaattgaggacatacagcacaaagaagtttctgagaatgcttctgtctagattttatatgaagatatcccgtttccaaagaaatcctcaaagctatccaaatatctacatccagattctacaaaaagactgtttcaaaacggctctgtcaaaagtaaggttcaactctgttacttgagtacacacatcacaaggaagtttctgagaattcttctgtctggtttttaggagaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagactctactaaaggaatgtttccaaaatgctgtatccacacaaaggttcaactctgttaattgaggacatacagcacaaagaagtttctgagaatgcttctgtctagattttatatgaagatatcccgtgtccaacgaaatcctcaaaggtatcaaaatatccacttgcagattctacaaaaagagtgcttcaaaactgctctgtcaaaaggaaggttcaactctgttacttgagtacacacatcacaaggaagtttctgagaatgcttctgtctggtttttaggagaagatatttcgttcttcaacataggcctcaaagcgctgcaaatgtccacttccaaatattacaaaaagagtgtttcaaacctgctgtatgaagggaagtgttcacctctatgagttgaatgtaaacatcacagaaaagtttctgagaatgtttctgtcttgattttatatgaagatattccggtttccaacgaaaccttcaaagctaaccaaatatccacttgcagatcctacaaaaagagtgtttccaaaacgttgtatccaaacaaaggttcaactcttttagttgagaacacacatcgcaaataagtttctgagaatgcttctgtctagtttttatttgaagatatttcctttttcaccacaggcctgaaagcgcttcaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctgcaaatgtccacttccaaatattacaaaaagagtgtttcaaacctgctgtatgaagggaagtgttcaactctatgagttgaatgcaaacatcacagagaagtttctgagaatgcttctgtcttgattttatatgcagatattcccgtttccaacgaaaccttcaaagctatccaaatatccacttgcagattctacaaaaaagtgtttccaaaatgttgtatcaaaacaaaggttcaactctgttagttgagaacacacatggcaaattagtttctgagaatgcttctgtctagtttttacttgaagatatttcctttctcaccataggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgaatgaagacatcacaaagcagtttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggttttgaggagaagatatttcctttttcaacataggcctcaaagcgctgcaaatgtcaacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaatcttcaaagctatccaaatatccacctgcagattctacaaaaagagtgtttccaaaatgttgtatccaaacaaaggttcaactatgttagttgaggacacacatcgcaaataagtttctgagaatccttctgtctagtttttatttgaagatatttcctttctcaccataggcctgaaatcgcttgaaatgtccgtttgcagatactacagaaagagtgtttcaaacatgctctatgaaagggaatgttcagttctgtgacgtgaatgcaaacatcacaaagaagttcctgagaatgcttctctctagattttacatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgaatgaagacatcacaaagcattttctcagaatgcttccgtctagattttatatgaagatattcccgtttccaaggaaatcttcctagctatctaaatatcaacatgcagattctactaaaggaatgtttccaaaatgctgtatccacacaaaggttcaactctgttaattgaggacatacagcacaaagaagtttctgagaatgcttctgtctagaatttgtatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctgtttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacctgcagattctacaaaaagagtgtttccaaaatgttgtatcaaaacaaaggttcaactctgttagttgaggacacacatcgcaaataagtttctgagaatgcttctgtctagtttttatttgaagatatttcctttctcaccataggcctgaaagcgcttgaaatgtccgtttgcagatactacagaaagagtgtttcaaacatgactctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctcggttagttgaatacacacatcacaaacaagtttctgagaatgcttctgtctagtttttatgggaagatatttcctttttcaacataggccacaaagcgctccaaatgtccacttccagatagtgcagaaagtgtgtctcaaacctggtatataaaagggaacattctactctgtgacttgaatgaaaacatcacaaaggagtttctgagagtgcttccgtctagattttatatgaagatattcccgtttccaacgaaaccttcaaagctatccgaatatccacctgcagattctacaaaaagagtgtttccaaaatgccgtatcaaaacaaagtttcaactctgttagttgagaacacacatggcaaataagtttctgagaatgcttctgtctagtttttacttgaagatatttcctttctcaccataggcctgaaagcgcttgaaacgtctgcttgcagatactacagaaagagtgtttcaaacatgctctatgaaagggaatgttcagttctgtgacttgaatgcatacatcacaaaaaagatcctgagaatgcttctctctagattttatatgtaatcccgtttccaacgaaatcctcaaagatatccaaatatccactttcagattccacaaaaagagtgtttcaaaactgctctgtaaaaagaaaggttcatctctgttagttgaatacacacatcacaaacaagtttctgagaatgcttctgtctagtttttatgggaggatatttcctttttcaacataggcctcaaagcgctccaaatgtccacttccaggtagtgcagaaagagtgtttcaaacctgctctataaaagggaatattcaactctgtgtcttgaatgcaaacatcacaaaacactttctgagaatgcttccgtctagattttatatgaagatattcccgtttccaacgaaatcttcctagctatctaaatatcaacttgcagattctactaaaggaatgtttccaaaatgctgtatcgaaacaaaggttcaactctgttaattgaggacatacatcacaaagaagtttctgagaatgcttctgtctagattttatatgaagatatcccgtgtccaacgaaatcctcaaaggtatcaaaatatccacttgcagattctacaaaaagagtgcttcaaaactgctctgtcaaaaggaaggttcaactctgttacttgactacacacatcacaagaaagattctgagaatgcttctgtctggtttttatgggaagatatctcttttttcaccataggcttcaaagcgctgccaatgtccacttccaaatattacaaaaagagtatttcaaaccacctctatgaaagaaagtgttcaactctatgagttgaatgcaaacatcacagagaagtttctgagaatgcttctgtcttgattttatatgaagatattcccgtttccaacgaaaccttcatagctatccaaatatccacttgcagattctacaaaaagagtgtttccaaaatgttgtatcaaaacaaaggttcaactctgttagttgagaacacacatcgcaaataagtttctgagaatgcttctgtctagtttttatttgaagatatttcctttttcaccataggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaagtttcatctctgttagttgaatacacacatcacaaacaagtttctgagaatgcttctgtctagtttttatgggaagatatttcctttttcaacataggcctcaaagcgctccaaacgtccacttccaggtagtgcagaaagagtgtctcaaacctggtatataacagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacctgctccatgaaagggaatgttcagtcctgtgacttgaaggccaacatcacaaagaagttcctgagaatgcttctctctaggttttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtctacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaaaaagtttctgagaatgcttctgtctagattttatatgaagatatcccgtgtccaacgaaatcctcaaaggtatcaaaatatccacttgcagattctacaaaaagagtgcttcaaaactgctctgtccaaaggaaggttcaactctgttacttgagtacacacatcacaaggaagtttctgagaatgcttctgtctgctttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgagaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatatgtaatcccgtttccaacgaaatcctcaaagctatccaaacatccactttcagattccacaaaaagagtgtttcaaaactgttctgtaaaaagaaaggttcatctctgttagttgaatacacacatcacaaagaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctctccgaatatccacctgcagattctacaaaaagagtgtttccaaaatgccgtatcaaaacaaaggttcaactctgttagttgagaacacacatggcaaataagtttctgagaatgcttctgtctagtttttagttgaagatatttcctttctcaccataggcctgaaagcgcttgaaacgtccgcttgcagatactacagaaagagtgtttcaaacatgctctatgaaagggaatgttcagttttgtgacttgaatgcaaacatcacaaagaagttcctgagaatgcttctctctagattttatatgtaatcccgtttccaacgaaatcctcaaagctatccacatatccactttcagattcaacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattgaactctgtgacttgaatgcaaacatcacaaagcactttctgagaatgcttccgtctagattttatatgaagatattcccatttccaaggaaatcttcctagctatctaaatatcaacttgcagattctactaaaggaatgtttccaaaatgccgtatccacacaaaggttcaactctgttaattgaggacatacagcacaaagaagtttctgagaatgcttctgtctagattttatatgaagatatcccgtttccaaagaaatcctcaaaggtatccaaatatctacttccagattccacaaaaagactgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatccaaacaaaagttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttcccggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggtatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaaggaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacttgaatgcaaacatcacaaagaagttcctgagaatgcttctctctagatcttaaatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatccaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttaaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccatttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaataaccacttgcagattctacaaaaagagtgtttccaaaatgttgtatcaaaacaaaggttcaactctgttagttgaggacacacatcgcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgcatgtaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattgaactctgtgacttgaatgcaaacatcacaaagcactttctgagaatgcttccgtctagattttatatgaagatattcccgtttccaaggaattcttcctagctatctaaatatcaacttgcagattctactaaaggaatgtttccaaaatgccgtatccacacaaaggttcaactctgttaattgaggtcatacagcacaaagaagtttctgagaatgcttctgtctagattttatatgaagatatcccgtttccaaagaaatcctcaaaggtatccaaatatctacttccagattccacaaaaagactgtttcaaaactgctctgtaaaaagaaaggttcatctctgttagttgaatacacacatcacaaacaagtttctgagactgcttctgtctagtttttatgggaagatatttcctttttcatcataggcctcaaagcgctccaaatgtccacttccagatagtgcagaaagagtgtctcaaacctggtatataaaagggaacattctactctgtgacttcaatgaaaacatcacaaagcagtttctgagaatgcttccgtctagattttatatgaagatattcccgtttccaacgaaaccttcaaagctatccgaatatccacctggagattctacaaaaagagtgtttccaaaatgccgtatccaaacaaaagttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgattcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatattccctttttcaacataggcctcaaagcgctccaaatgtccacttccaggtagtgcagaaagagtgtttcaaacctgctctataaaagggaatattcaactctgtgacctgaatgcaaacatcacaaagcactttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactttttcaaaacggctctgtcaaaagtaaggttcaactctgttacttgagtacacacatcacaaggaactttctgagaatgcttctgtctggtttttaggagaagatatttccttttccaacataggcctcaaagcgctgcaaatgtccacttacaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttctcaccataggcctgaaagcgcttgaaacgtccgcttgcagatactacagaaagagtgtttcaaacctgctctatgaaacggaatgttcagttctgtgacttgaatgcaaacatcacaaagaagttcctgagaatgcttctccctagattttttatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctgcaaatgtccacttccaaatattacaaaaagagtgtttcaaacctgctctatgaagggaagtgttcaactctgtgagttgaatgcaaacatcacagagaagtttctgagaatgcttctgtctagattttatatgaagatattcccgtttccaacgaaaccttcaaagctatccaaatatccacatgcagattctacaaaaagagtgtttccaaaatgctgtatcaaaacaaaggttcaactctgttagttgagaacacacatcgcaaataagtttctgagaatgcttctgtctagtttttatttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggaatgtttccaaaatgccgtatccacacaaaggttcaactctgttaattgaggacatacagcacaaagaagtttctgagaatgcttctgtctagattttatatgaagatatcccgtttccaaagaaatcctcaaaggtatccaaatatctacttccagattccacaaaaagactgtttcaaaactggtctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttcaatgaaaacatcacaaagcagtttctgagaatgcttccgtctagattttctatgaagatattcccgtttccaacgaaaccttcaaagctatccgaatatccacctgcagattctacaaaaagagtgtttccaaaatgccgtatccaaacaaaggttcaactctgttagttgaggacacacatggcaaataagtttctgagaatgcttctgtctagtttttacttgaagatattccctttctcaccataggcctgaaagcgcttgaaacgtccgcttgcagatactacagaaagagtgtttcaaacatgctctatgaaagggaatgttcagttctgtgacttgaatgcaaacatcacaaagaagtgcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatatttcaactctgtgacttgaatgcaaacatcacaaagcacttttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtgtccaacgaaatcctcaaaggtatcaaaatatccacttgcagattctacaaaaagagtgcttcaaaactgctctgtcaaaaggaaggttcaactctgttacttgagtacacacatcacaaggaagtttctgagaatgcttctgtctggtttttatgagaagatatttcctttttcaacataggcctcaaagcgctgcaaatgtccacttccaaatattacaaaaagagtgtttcaaacctgctctatgaagggaagtgttcacctctatgagttgaatgcaaacatcacagagaagtttctgagaatgcttctgtcttgattttatatgaagatattcccgtttccaacgaaaccttcaaagctatccaaatatccacctgcagatcctacaaaaagagtgtttccaaaatgctgtatcaaaacaaaggttcaactctattagttgagaacacacatcgcaaataagtttctgagaatgcctctgtctagtttttatttgaagatatttcctttttcaccacaggcctgaaagcgcttgaaacgtccgcttgcagatactacagaaagagtgtttcaaacctgctctatgaaagggaacgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgaatgcaaacatcacaaagcagtttctgagaatgcttccgtctagattgtatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaatgtatccaaatatctacttccagattctacaaaaagactgtttcaaaacggctctgtcaaaaggaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagtgtgtttcaaacctgctctatgaagggaagtgttcaactctatgagttgaatgcaaacatcacagagaagtttctgagaatgcttctgtcttgattttatatgaagatattcccgtttccaacgagaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaaggaaggttcatctctgttagttgaatacacacatcacaaacaagtttctgagaatgcttctgtctagtttttatgggaagatatttcctttttcatcataggcctcaaagcgctcctaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatgcgaatatccacctgcagattctacaaaaagagtgtttccaaaatgccgtatcaaaacaaaggttcaactctgttagttgagaacacacatggcaaataagtttctgagaatgcttctgtctagtttttacttgaaggtatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctggaatgcttctctctagatcttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttttgtgtcttgaatgcaaacatcacaaagaagttcctgagaatgcttctctctagattttatatgtaatcccgtttccaacgaaatcctcaaagctatccacatatccactttcagattccacaaaaagagtgtttcaaaactgctctgtaaaaagaaaggttcatctctgttagttgaatacacacatcacaaacaagtttctgagcatgcttctgtctagtttttatgggaagatatttcctttttcaacataggcctcaaagcgctcctaatgtccacttccaggtagtgcagaaagagtgtttcaaacatgctctataaaagggaatattcaactctgtgacttgaatgcaaacatcacaaagcactttctgagaatgcttccttctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactgtgttacttgagtacacacatcacaaggaagtttctgagaatgcttctgtctggtttttaggagaagatatttcctttttcaacataggcctcaaagagctgcaaatgtccacttccaaatactacaaaaagaatgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggaatgtttccaaaatgccgtatccacacaaaggttcaactctgttaattgaggacatacagcacaaagaagtttctgagaatgcttctgtctagattttatatgaagatatcccgtttccaaagaaatcctcaaaggtatccaaatatctacttccagattccacaaaaagactgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccatttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaagtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgtttctgtcttgattttatatgaagatattcccgtttccaacgaaaccttcaaagctatccaaatatccacttgcagattctacaaaaagagtgtttccaaaatgttgtatcaaaacaaaggttcaactctgttagttgagggcacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatacgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaaggtatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttccttttcaaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccatttccaaggaaatcttcctagctatctaaatatcaacttgcatatcctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtgtccaaatatctacttccagattctacaaaaagactgtttcaaaacggctctgtcaaaagtaaggttcaactctgttacttgagtacacacatcacaaggaagtttctgagaatgcttctgtctgctttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgctaataagtttctgagaatgcttctgtctagtttttatttgaatatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctccctagattttatatgtaataccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacatactactctgtgacttgaatgaagacatcacaaagcagtttctgagaatgcttccgtctagattttatatgaagatatacccttttccaaggaaatctaattagctatctaaatatcaacttgcagattctactaaaggaatgtttccaaaatgctgtatccacacaaaggttcaactctgttaattgaggacatacagcacaaagaagttcctgagaatgcttctgtctagattttatatgaagatatcccgtttccaaagaaatcctcaaaggtatccaaatatctagttccagattctacaaaaagactgtttcaaaacggctctgtcaaaagtaaagttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctgtatgaaaggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaagaaaggttcaactctgttagttgaggacacacatcgcaaataagtttctgagaatgcttctgtctagtttttatttgaagatatttcctttttcaccacaggcctgaaagcgcttgaaacgtcagcttgcagatactacagaaagagtgtttcaaacctgcactatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactactctgtaaaaagaaagggtcatctctgttagttgaatacacacatcacaaacaagtttctgagaatgcttctgtctagtttctatgggaagatatttcctttttcaacataggcatcaaagcgctccaaatgtccacttccaggtagtgcacagagtgtttcaaacctgctctataaaagggaacattctactctgtgacttgaatgaagacatcacaaagcagtttctgagaatgcttccgtctagattttatatgaagatgttcccttttccaaggaaatcttattagctatctaaatatcaacttgcagattctactaaaggaatgtttccaaaatgctgtatccacacaaaggttcaactctgttaattgaggacatacagcacaaagaagttcctgagaatgcttctgtctagattttatatgaagatatcccgtttccaaagaaatcctcaaaagtatccaaatatctacttccagattctacaaaaagactgtttcaaaacggctctgtcaaaagtaaggttcaactctgttacttgagtacacacatcacaagaaagtttccgagaatgcttctgtctggtttttaggagaagatatttcctttttcaacataggcctcaaagcgctgcaaatgtccacttccaaatattacaaaaagagtgtttcaaacctgctgtatgaagggaagtgttcaactctatgagttgaatgcaaacatcacagagaagtttctgagaatgtttctgtcttgattttatatgcagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttctcaccataggcctgaaagcgtttgaaatgtccgtttgcagatactacagaaagagtgtttcaaacatgctctatgaaagggaatgttcagttctgtgacgtgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgattctgtctagtttttatgggaagatatttcctttttcatcataggcctcaaagcgctccaaatgtccacttccaggtagtgcagaaagagtgtctcaaacctggtatataacagggaacattctactctgtgacttgaatgaaaacatcacaaagcagtttctgagaatgcttccgtccagattttatatgaagatattcccgtttccaacgaaaccttcaaagctatccgaatatccaccagcagattctacaaaaagagtgtttccaaaatgccgtatcaaaacaaatgttcaactctgttagttgagaacacacatggcaaataagtttctgagaatgcttctgtctagtttttacttgaagatatttcctttctcaccataggcctgaaagcgcttgagacgtcctcttgcagatactacagaaagagtgtttcaaacctgctctatgaaagggaatgttcagttctgtgacttgaatgcaaacatcacaaagaagttcctgagaatgcttctctctaggttttatatgtaatcccgttccaacgaatctcaagtagtcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtttccaagaaatcctcaaaggtatccaaatatctacttccagattccacaaaaagactgtttcaaactggtctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaataaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccatagggctgaaagcgcttgtaacgtccgcttgcagatactacagaaggagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcatatcctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaaggaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatccactttcagattccacaaaaagagtgtttcaaaactgttctgtaaaaagaaaggttcatctctgttagttgaatacacacatcacaaagaagtttctgagaatgcttctgtctagtttttatgggaagatatttcctttttcatcataggcctcaaagcgctccaaatgtccatttcctgatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctctccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttttgtgacttgaatgcaaagatcacaaagaagttcctgagaatgcttctctctagattttatatgtaatcccgtttccaacgaaatcctcaaagctatccacatatccactttcagattcaacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacatgctctataaaagggaatattcaactctgtgacttgaatgcaaacatcacaaagcactttctgagaatgcttccttccagattttatatgaagatattcccgtttccaaggaaatcttcgtagctatctaaatatcaacttgcagattctactaaaggaatgtttccaaaatgctgtatccacacaaaggttcaactctgttaattgaggacatacagcagaaagaagtttctgagaatgcttctgtctatattttatatgaagatatcccgtttccaaagaaatcctcaaaggtatccaaatatctacttccagattctacaaaaagactgtttcaaacggctctgtcaaaagtaaggttcaactctgttacttgagtacacacatcacaaggaagtttctgagaatgcttctgtttggtttttaggagaagatatttcctttttcaacataggcctcaaagagctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacttgaatgcaaacatcacaaagaagttcctggaatgcttctctctagatcttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttttgtgtcttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcaactctgttacttgagtacacacatcacaaggaagtttctgagaatgcttctgtctggtttttaggagaagatatttcctttttcaacataggcctcaaagagctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtcttgtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagttattcccgtttccaacgaaaccttcaaagctatccgaatatccacctgcagattctacaaaaagagtgtttccaaaatgccgtatcaaaacaaaggttcatctctgttagttgaatacacacatcacaaacaagtttctgagaatgcttctgtctagtttttatgggaagatatttcctttttcaacataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctgaatatccacttgcagattctactaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttttgtgacttgaatgcaaacatcacaaagaagttcctgagaatgcttctctctagattttatatgtaatcccgtttccaacgaaatcctcaaagctatccacatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacatgctctataaaagggaatattcaactctgtgacttgaatgcaaacatcacaaagcactttctgagaatgcttccttccagattttatatgaagatattcccgtttccaaggaaatcttcctagctatctaaatatcaacttgcagattctactaaaggaatgtttccaaaatgctgtatccacacaaaggttcaactctgttaattgaggacatacagcagaaagaagtttctgagaatgcttctgtctatattttatatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagagctgcaaatgtccacttccaaatactacaaaaagaatgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaataaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccatagggctgaaagcgcttgtaacgtccgcttgcagatactacagaaggagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagttttaatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcatatcctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtttggtttttaggagaagatatttcctttttcaacataggcctcaaagagctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacttgaatgcaaacatcacaaagaagttcctggaatgcttctctctagatcttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccagatagtgcagaaagagtgtatcaaacctggtatataaaagggaacattttgatgtatgacggcaatgaaaacatcacaaagcagtttctgagaatggatccgtatagatattataagaagacattccggaatccatcgaaacgttgcaatagataagctgaatcatccacccgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttaaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccatttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttcggagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacttgaatgcaaacatcacaaagaagttcctgagaatgcttctctctagatcttaaatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtcttgtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagttattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctgctatataaaagggaatattctactctgtgacttgaatgaaaacatcacaaagcactttctgagaatgcttccgtctagattttatatgaagatattcccgtttccaacgaaatcttcctagctatctaaatatcaacttgcatattctactaaaggagtgtttccaaaatgctgtatccacacaaaggttcaactctgttaattgaggacatacagcacaaagaagtttctgagaatgcttctgtctagattttatatgaagatatcccgtttccaaagaaatcctcaaaggtgtccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcacctctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgttttaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtgtataaaagggaacattctactctgtgacttgaatgaaaacatcacaaagcagtttctgagaatgcttccgtctagattttctatgaagatattcccgtttccaacgaaaccttcaaagctatccgaatatccacctgcagattctacaaaaagagtgtttccaaaatgccgtatccaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctaagaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattatactaaaggaatgtttccaaaatgctgtatccacacaaaggttcaactctgttaattgaggacatacagcacaaagaagtttctgagaatgcttctgtctagattttatatgaagacatcccgtttccaaagaaatcctcaaaggtgtccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgttttaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatacactttcaaattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgaatccaaacaaaggttcaactctgttagttgagaacacacatggcaaataagtttctgagaatgcttctgtctagtttttacttgaagatatttcctttctcaccataggcctgaaagcgcttgaaacgtccgctttgcaaatccaacaaaaaaattttttcaaactgctctataaaagggaatgttcagttttgtgacttgaatgcaacatcacaaaaaatttcctgagaatgcttctccctaaattttatatgtaatcccgtttccacgaaatcctcaaagctatccaaatatccactttcagattccacaaaaagagtgttttaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcacagactgtttcaaacctgctctatgaaaggaagtgttcaactccatgagttgaatgcaaacatcacagagaagtttctgagaatgcttctgtcttgattttatatgaagatattcccgtttccaacgaaaccttctaagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttttcaccacaggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtcatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgaatgaagacatcacaaagcagtttctgagaatgcttccgtctagattttatatgaagatattcccgtttccaaggaaatcttcctagctatctaaatatcaaattgcagattctactaaaggaatgtttccaaaatgctgtatccacacaaaggttcaactctgttaattgagaacacacatcacaaagaagtttctgagaatgcttctgtctcaagtaacagagttgaaccttccttttgacagagccgttttgaaacagtctttttgtagaatctggaagtagatatttggatacctttgaggatttctttggaaacgggatatcttcatataaaatctagacagaagcattctcagaaacttctttgtgatgtttgcactcaaatcacagagctgaacattccctttcttagagcacgtttgaaactctctttttgtagtatctggaagtggacatttggagtgatttgaggcctatggtgaaaaagcaaatatcttcccattaaaactagacagaagcattctcaaaacttgattgtgatgtgcgtactcaagtaagagagttgaaccattcttttgatagaactgttttgaaacactctttttgtagaatctgcaagtgcgtatttggatagctttgaggatttcattgcaaatgggaatatccatataaaaagtagacagaaggattctcagaaacttctttgtaatgtttgtattcaagtcacagaggtgaacattgcctttcataaagcaggtttgacacactctttttatagtatctggaagtggacatctggagcgctttgaggactatggtgaanaaggaactatcttctcataaaaactagaaagaatcattctcaaaaacttgtttgttatgtatgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacgaccgaaatatccgtttcgaagaatcctcaaagttatccaaatatctacttccagattctacaaaaagactttttcaaacggctctgtcaaaagtaaggttcaactctgttacttgagtacacacatcacaaggaactttctgagaatgcttctgtctggtttttaggagaagatatttccttttccaacataggcctcaaagcgctgcaaatgtccacttacaaatattacaaaaagagtgtttcaaacctgctctgtgaagggaagtgttcaactctatgagttgaatgcaaacatcacagagaagtttctgagaatgcttctgtcttgattttatatgaagatattcccgtttccaacgaaaccttcaaagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttctcaccataggcctgaaagcgcttgaaacgtccgcttgcagatactacagaaagagtgtttcaaacctgctctatgaaacggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcacagagtgtttcaaacctgctctatgaaaggtagtgttcaactctatgagttgaatgcaaacatcacagagaagtttctgagaatgcttctgtcttgattttatatgaagatattcccgtttccaacgaaaccttcgaagctatccaaatatccacttgcagattctacaaaaagagtgtttccaaaatgttgtatccaaacaaaggttcaacactgttagttgagaacacacatcgcaaataagtttctgagaatgcttctgtctagtttttatttgaagatatttcctttttcaccacaggcctgaaagcgcttgaaacgtcagcttgcagatactacagaaagagtgtttcaaacctgctctatgaaagggaatgttcagttctgtgacgtgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataagcctcaaagcgctccaaatgtccacttccaggtagtgcactgagagtttctcacctgctctataaaagggaacattctactctgtgacttgaatgatgacatcacacagcagtttctgagaatgcttccgtctagattttatgtgaagatattcccgtttcccaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtgtccaacgaaatcctcaaaggtatcaaaatatccacttgcagattctacaaaaagagtgcttcaaaactgctctgtcaaaaggaaggttcaactctgttacttgagtacacacatcacaaggaagtttctgagaatgcttctgtctggtttttaggagaagatatatcctttttcaacataggcctcaaagcgctgccaatgtccacttccaaatattacaaaaagagtgtttcaaatctgctgtatgaagggaagtgttcaactctatgagttgaatgcaaatatcacagagaagtttctgagaattcttctgtcttgattttatatgaagatattcccgttaacaacgaaaccttcaaagctatccaaatatccacttgcagattctacaaaaagagtgtttccaaaatgttgtatccaaacaaaggttcaactctgttagttgagaacacacatcacaaataagtttctgagagtgcttctgtctagtttttatttgaagatatttcctttttcaccacaggcctgaaagcgcttgaaacgtcagcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccaatttcagattccacaaaaagagtgtttcaaaactactctgtaaaaagaaaggttcatctctgttagttgaataaacacatcacaaacaagtttctgagaatgcttctgtctagtttctatgggaagatatttcctttttcaacataggcttcaaagcgctccaaatgtccacttccaggtagtgcacagagtgtttcaaacctgctctataaaagggaacattctactctgtgacttgaatgaagacatcacaaagcagtttctgagaatgcttccgtctagattttatatgaagatattcccttttccaaggaaatcttattagctatctaaatatcaacttgcagattctactaaaggaatgtttccaaaatgctgtatccacacaaaggttcaactctgttaattgaggacatacagcacaaagaagttcctgagaatgcttctgtctagattttatatgaagatatcccgtttccaaagaaatcctcaaaggtatccaaatatctagttccagattctacaaaaagactgtttcaaaacggctctgtcaaaagtaaagttcaactctgttacttgagtacacacatcacaaggaagtttctgagaatgcttctgtctggtttttaggagaagatatttcgtttttcaacataggcctcaaagcgctgcaaatgtccacttccaaatattacaaaaagagtgtttcaaacctactgtatgaaaggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaagaaaggttcaactctgttagttgaggacacacatcgcaaataagtttctgagaatgcttctgtctagtttttatttgaagatatttcctttttcaccacaggcctgaaagcgcttcaaacgtccgcttgcagatactacagaaagagtgtttcaaacctgctctatgaaagggaatgttcagttctgtgacttgaatgcaaacatcactaagaagttcctgagaatgcttctccctagattttatatgtaatcccgtttccaacgaaatcctcaaagctatccaaatatccactttcggattccacaaaaagagtgtttcaaaactactctgtaaaaagaaaggttcatctctgttagctgaatacacacatcacaaacaagtttctgagaatgcttctgtctagtttctatgggaagatatttcctttttcaacataggcctcaaagcgctccaaatgtccacttccaggtagtgcacaagagtgtttcaaacctgctctataaaagggaacattctactctgtgacttgaatgaagacatcacaaagcagtttctgagaatgcttccgtctagattttatatgaagatattcccgtatccaaggaaatcttattagctatctaaatatcaacttgcagattctactaaaggaatgtttccaaaatgctgtatccacacaaaggttcaactctgttaattgaggacatatagcacaaagaagttcctgagaatgcttctgtctagattttatttgaagatatcccgtttccaaagaaatcctcaaaggtatccaaatatctagttccagattctacaaaaagactgtttcaaaacggctctgtcaaaagtaaagttcaactctgttacttgagtacacacatcacgaggaagtttctgagaatgcttctgtctggtttttaggagaagatatttcctttttcaacataggcctcaaagcgctgcaaatgtccacttccaaatattacaaaaagagtgtttcaaacctgctgtatgaaaggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagattctgagaatgcttctgtctagtttttatttgaagatatttcctttttcaccacaggcctgaaagcgcttcaaacgtccgcttgcagatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcggattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcacaaagagtgtttcaaacctgctctatgaaaggaagtgttcaactctatgagttgaatgcaaacatcacagagaagtttctgagaatgcttctgtcttgattttatatgaggatattcccgtttccaacgaaaccttcaaagctatccaaatatccacctgcagatcctacaaaaagtgtgtttccaaaatgctgtatcaaaacaaaggttcaactctgttagttgagaacacacatcgcaaattagtttctgagaatgcttctgtctagtttttatttgaagatatttcctttttcaccacaggcctgaaagcgcttgaaacttccgcttgcagatgctacagaaagagtgtttcaaagctgctctatgaaagggaatgttcagttctgtgacttgaatgcaaacatcacaaagaagttcctgagaatgcttctacctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcactgagtgtttcaaacctgctctataaaagggaacattctactctgtgacttgaatgaagacatcacaaagcagtttctgagaatgcttccgtctagattttatgtgaagatattcccgtttccaaggaaatcttcctagctatctaaatatcaacttgcagattctactaaaggagtgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccaaattctacaaaaagactgtttcaaaacggctctgtcaaaagtaaggttcaactctgttacttgagtacacacatcacaaggaagtttctgagaatgcttctgtctggtttttaggagaagatatttcctttttctacataggcctcaaagcgctgcaaatgtccacttccaaatattacaaaaagagtgtttcaaacctgctgtatgaagggaagtgttcaactctatgagttgaatgcaaacaacacagagaagtttctgagaatgcttctgtcttgattttatataaagatattcccgtttccaacgaaaccttcaaagctatccaaatatccacctgcagatcctacaaaaagagtgtttccaacatgctgtatcaaaacaaaggttcaactctgttagctgagaacacacatcgcaaataagtttctgagaatgcttctgtctagtttttatttgaagatatttcctttttcaccacaggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttataagtaatcccgtttccaacgaaatcctcaaagctatccaaatatccactttcagattccacaaaaagagtgttgcaaaactgctctgtaaaaagaaaggttcatctctgttagttgaatacacacatcacaaacaagtttctgagaatgcttctgtctagtttttatgggaagatatttcctttttcaacataggcctcaaagcgctccaaacgtccacttccaggtagtgcagaaagagtgtctcaaacctggtatataacagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtcagcttgcagatactacagaaagagtgtttcaaacctgctccatgaaagggaatgttcagtcctgtgacttgaaggccaacatcacaaagaagttcctgagaatgcttctctctaggttttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtctacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtgtccaacgaaatcctcaaaggtatcaaaatatccacttgcagattctacaaaaagagtgcttcaaaactgctctgtccaaaggaaggttcaactctgttacttgagtacacacatcacaaggaagtttctgagaatgcttctgtctgctttttaggagaagatatttcctttttcaacataggcctcaaagcgctggaaatgtccacttccaaatattagaaaaagagtgtttcaaacctgctgtatgaagggaagtgttcaactctatgagttgaatgcaaacatcacagagaagtttctgagaatgcttctgtcttgattttatatgtagatattcccgtttccaacgaaaccttcaaagctatccaaatatccacttacagattctacaaaaagagtgtttccgaaatgttgtatccaaacaaaggttcaactcttttagttgagaacacacatcgcaaataagtttctgagaatgcttctgtctagtttttatttgaagatatttcctttttcaccacaggcctgaaagagcttcaaacgttcgcttgcaaatactacagaaagagtgtttcaaacctgctctatgaaagggaatgttcagttctgtgacttgaatgcaaacatcacaaagaagttcctgagaatgcttctccctagattttatatgtaatcccgtttccaacgaaatcctcaaagctatccaaatatccactttcggattccacaaaaagagtgtttcaaaactactctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcaaaaagagtgtttcaaacctgctctataaaagggaatattcaactctgtgacttgaatgcaaacatcacaaagcactttctgagaatgcttccggctagattttatatgaagatattcccgtttccaaggaaatcttcctagctatctaaatatcaacttgcagattctactaaaggaatgtttccaaaatgctgtatcgacacaaaggttcaactctgttaattgaggacatacagcacaaagaagtttctgagaatgcttctgtctagattttatatgaagatatcccgtgtccaacgaaatcctcaaaggtatcaaaatatccacttgcagattctacaaaaagagtgcttcaaaactgctctgtcaaaatgaaggttcaactctgttacttgagtacacacatcacaagaaagattctgagaatgcttctgtctggtttttaggagaagatatctcctttttcaccataggcttcaaagcgctgccgatgtccacttccaaatattacaaaaagagtatttcaaaccagctctatgaaaggaagtgttcaactctatgagttgaatgcaaacatcacagagaagtttctgagaaggcttctgtgttgattttatatgaagatattcgcctttccaacgaaatcttcaaagctatccaaatatccacctgcagatcctacaaaaagagtgtttccaaaatgctgtatcaaaacaaaggttcaactctattagttgagaacacacatcgcaaataagtttctgagaatgcctctgtctagtttttatttgaagatatttcctttttcaccacaggcctgaaagcgcttgaaacgtccgcttgcagatactacagaaagagtgtttcaaacctgctctatgaaagggaacgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctgcaaatgtccacttccaggtagtgtacagagtgtttcaaacctgctctatgaaaggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccgaaatgttgtatccaaacaaaggttcaactcttttagttgagaacacacatggcaaataagtttctgagaatgcttctgtctagtttttatttgaagatatttcctttttcaccacaggcctgaaagcgcttcaaacgtccgcttgcagatactacagaaagagtgtttcaaacctgctctatgaaagggaatgttcagttctgtgacttgaatgcaaacatcacaaagaagttcctgagaatgcttctccctacattttatatgtaatcccgtttccaacgaattcctcaaagctatccaaatatccactttcggattccacaaaaagagtgtttcaaaactactctgtaaaaagaaaggttcatctctgttagttgaatacacacatcacaaacaagtttctgagaatgcttctgtctagtttttatgggaagatatttcctttttcatcataggcctcaaagcgctgcaaatgtccacttccaaatattacaaaaagagtgtttcaaacctgctgtatgaagggaagtgttcatctctatgagttgaatgcaaacatcacagagaagcttctgagaatgcttctgtcttgattttatatgaagatattcccgtttccaatgaaaccttcaaagctatccaaatatccaattgcagattccacaaaaagagtgtttccaaaatgttgtatcaaaagaaaggttcaactctgttagttgaggatacacatcgcaaataagtttctgagaatgcttctgtctagtttttatttgaagatatttcctttctcaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctctccgaatatccacctgcagattctacaaaaagagtgtttccaaaatgccgtatcaaaacaaaggttcaactctgttagttgagaacacacatggcaaataagtttctgagaatgcttctgtctagtttttagttgaagatagttcctttctcaccataggcctgaaagcgcttgaaacgtccgcttgcagatactacagaaagagtgtttcaaacatgctctatgaaagggaatgttcagttttgtgacttgaatgcaaacatcacaaagaagttcctgagaatgcttctctctagattttatatgtaatcccgtttccaacgaaatcctcaaagctatccacatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacatgctctataaaagggaatattcaactctgtgacttgaatgcaaacatcacaaagcactttctgagaatgcttccttccagattttatatgaagatattcccgtttccaaggaaatcttcctagctatctaaatatcaacttgcagattctactaaaggaatgtttccaaaatgctgtatccacacaagggttcaactctgttaattgaggacatacagcacaaagaagtttctgagaatgcttctgtctagattttttatgaagatatcccgtttccaaagaaatcctcaaaggtatccatatatctacttccagattctacaaaaagactttttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacctgcagatcctacaaaaagagtgtttccaaaatgctgtatcaaaacaaaggttcaactctgttagttgagaagacacatcgcaaataagtttctgagaatgcttctgtctagtttttatttgaagatatttcctttttcaccacaggcctgaaagcgcttgaaacgtccgcttgcagatactacagaaagagtgtttcaaacctgctctatgaaagggaatgttcagttctgtgacttgaatgcaaacatcacaaagaagttcctgagaatgcttctccctagattttatatgtcatcccgtttccaacgaaatcctcaaagctatccaaatatccactttcagattccacaaaaagagtgtttcaaaactgcactgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgatggaagacatcacaaagcagtttctgagaatgcttccgtctagattttatatgaagctattcccgtttccaaggaaatcttcctagctatctaaatatcaacttgcagattctactaacggaatgtttccaaaatgctgtatccacacaaaggttcaactctgttaattgaggacatacagcacaaagaagtttctgagaatgcttctgtctagattttatatgaagatatccggtgtccaacgaaatcctcaaaggtatcaaaatatccacttgcagattctacaaaaagaatgttacaaaaatgctctgtcaaaaggaaggttcaactctgttacttgagtacacacatcacaaggaagtttctgagaatgcttctgtctggtttttaggagaagatatctcctttttcaccataggcctcaaagcgctgccaatgtccacttccaaatattacaaaaagagtgtttcaaaccagctccatgataggaagtgttcaactctatgagttgaatgcaaacatcacagagaagtttctgagaatgcttctgtcttgattttatatgaagatattcccgtttccaacgaaaccttcaaagctatccaaatatccacctgcagatcctgcaaaagagtgtttccaaaatgctgtatcaaaacaaaggttcaacactgttatttgagaacacacatcgcaaataagtttctgagaattcttctgtctactttttatttgaagatatttcctttttcaccagaggcctgaaagcgcttgaaacgtccgcttgcagatactacggaaagagtgtttcaaacctgctctatgaaagggaatgttcagttctgtgacttgaatgcaaacatcacaaagaaattcctgagagtgcttctccctagattttatatgtaatcccgtttccaacgaaatcctcaaagctatcaaatatccactttcagattccacaaaaagagtgtttcaaaactgctctgtaaaaagaaaggttcatctctgttagttgaatacacacatcacaaacaagtttctgagaatgcttctgtctagttgttatgggaagatatttcctttttcatcataggtctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagttattcccgtttccaacgaaaccttcaaagctatccgaatatgcacccgcagattctacaaaaagaatgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaggagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgcttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggtatgtttccaaaatgctgtatccacacaaaggttcaactctgttaattgaggacatacatcgcaaataagtttctgagaatgcttctgtctagattttatatgaagatatttcccgtttcaccacaggcctgaatgcgcttgaaacgtccgattgcagatactacagaaagagtgtttcaaacctgctctatgaaagggaatgttcagttctgtgacttgaatgcaaacatcacaaagaagttcctgagaatgcttctccctagattttatatgtcatcccgtttccaacgaaatcctcaaagctatccaaatatccactttcagattccacaaaaagagtgtttcgaaactgctctgtaaaaagaaaggttcatctgtgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgattgaagacatcacaaagcagtttctgagaatgcttccgtctagattttatatgaagatattcccgttcccaaggaaatcttcctagctatctaaatatcaacttgcagattctaccaaaggaatgtttccaaaatgctgtatccacacaaagcttcaactctgttaattgaggacatacagcacaaagaagtttctgagaatgctccagtctagattttttatgaagatatcccgtttccaaagaaatcctcaaaggtatccaaatatctacttccagattctacaaaaagactttttcaaaacggctctgtcaaaagtaaggttcaactctgttacttgagtacacacatcacaaggaactttctgagaatgcttctgtctggtttttaggagaagatatttccttttccaacataggcctcaaagcgctgcaaatgtccacttacaaatattacaaaaagagtgtttcaaacctgctctgtgaagggaagtgttcaactctatgagttgaatgcaaacatcacagagaagtttctgagaatgcttctgtcttgattttatatgaagatattcccgtttccaacgaaaccttcaaagctatccaaatatccacctgcagatcctacaaaaagagtgtttccaaaatgctgtatcaaaacaaaggttcaactctgttagttgagaacacacatcgcaaataagtttctgagaatgcttctgtctagtttttatttgaagatatttcctttctcaccataggcctgaaagcgcttgaaacgtccgcttgcagatactacagaaagagtgtttcaaacctgctctatgaaacggaatgttcagttctgtgacttgaatgcaaacatcacaaagaagttcctgagaatgcttctccctagattttttatgtaatcccgtttccaacgaaatcctcaaagctatccaaatatccactttcagattccacaaaaagagtgtttcaaaactgctctgtaaaaagaaagcttcatctctgttagttgaatacacacatcacaaacaagtttctgagaatgcttctgtctagtttttatgggaagatatttcctttttcaacataggcctcaaagcgctgtaaatgtccacttccaaatattacaaaaagagtgtttcaaacctgctctatgaagggaagtgttcaactctatgagttgaatgcaaacatcactgagaagtttctgagaatgcttctgtcttgattttatatgaagatattcccgtttccaacgaaaccttcaaagctatccaaatatccacatgcagatcctacaaaaagagtgtttccaaaatgctgtatcaaaacaaaggttcaactctgttagttgagaacacacatcgcaaataagtttctgagaatgcttctgtctagtttttatttgaagatatttcctttttcaccacaggcctgaaagcgcttgaaacgtccgcttgcagatactacagaaagagtgtttcaaacctgctctatgaaagggaatgttcagttgtgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcacagagtgtttcaaacctgctctataaaagggaacattctactctgtgacttgaatgaatacatcacaaagcagtttctgagaatgcttccgtctagattttatatgaagatattcccgtttccaaggaaatcttcctagctatctaaatatcaacatgcagattctactaaaggaatgtttccaaaatgctgtatccacacaaaggttcaactctgttaattgaggacatacagcacaaagaagtttctgagaatgcttctgtctagaatttgtatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctgtttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacctgcagattctacaaaaagagtgtttccaaaatgttgtatcaaaacaaaggttcaactctgttagttgaggacacacatcgcaaataagtttctgagaatgcttctgtctagtttttatttgaagatatttcctttctcaccataggcctgaaagcgcttgaaatgtccgtttgcagatactacagaaagagtgtttcaaacatgactctatgaaagggaatgttcagttctgtgacttgaatgcaaacatcacaaagaagttcctgagaatgcttctccctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgaatgaagacatcacaaagcagtttctgggaatgcttccgtctagattgtatatgaagatattcccgtttccaaggaaatcttcctagctatctaaatatcaacttgcagattctagtaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtcttgtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatccactttcagattccacaaaaagagtgtttcaaaactgttctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctaagaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatattccctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggaaatacagcacaaagaagtttctgagaatgcttctgtctagattttatatgaagatatcccgtttccaaagaaatcctcaaaggtgtccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctggtatataaaagggaacattctactctgtgacttgaatgaaaacatcacaaagcagtttctgagaatgcttccgtctagattttatatgaagatattcccgtttccaacgaaaccttcaaagctatccgaatatccacctgcagattctacaaaaagagtgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagttcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcctcaaaagtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacttgcagattctacaaaaagagtgtttccaaaatgttgtatcaaaacaaaggttcaactctgttagttgaggacacacatcgcaaataagtttctgagaatgcttctgtctagtttttatttgaagatatttcctttcttaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttatacgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctgctctataaaagggaatattctactctgtgacttcaatgaaaacatcacaaagcactttctgagaatgcttccgtctagattttatatgaagatattcccgtttccaacgaaaccttcaaagctatccgaatatgcacccgcagattctacaaaaagaatgtttccaaaatgccgtatcaaaacaaaggttcaactctgttagttgagaacacacatggcaaataagtttctgagaatgcttctgtctagtttttacttgaagatatttcctttctcaccataggcctgaaagcgcttgaaacgtccgcttgcagatactacagaaagagtgtttcaaacatgctctatgaaagggaatgttcagttctgtgacttgaatgcaaacatcacaaagaagtgcctgagaatgcttctctctagattttatatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctctataaaagggaatattcaactctgtgacttgaatgcaaacatcacaaagcactttctgagaatgcttccgtctagattttatatgaagatattcccgtttccaaggaaatcttcctagctatctaaatatcaacttgcagattctactaaaggaatgtttccaaaatgccgtatccacacaaaggttcaactctgttaattgaggacatacagcacaaagaagtttctgagaatgcttctgtctagattttatatgaagatatcccgtttccaaagaaatcctcaaaggtatccaaatatctacttccagattctacaaaaagactgtttcaaaactgctctgtaaaaagaaaggttcatctctgttagttgaatacacacatcacaaacaagtttctgagaatgcttctgtctagtttttatgggaagatatttcctttttcatcataggcctcaaagcgctccaaatgtccacttccagatagtgcagaaagagtgtctcaaacctgctctataaaagggaacattctactctgtgacttcaatgaaaacatcacaaagaagtttctgagaatgcttccgtctagattttatatgaagatattcccgtttccaacgaaaccttcaaatctatccaaatatccacctgcagatcctacaaaaagagtgtttccaaaatgccgtatcaaaacaaaggttcaactctgttagttgagaacacacatcgcaaataagtttctgagaatgcttctgtctagtttttatttgaagatatttcccttttcaccacaggcctgaaagcgctcgaaacgtccgctngcagatactacagaaagagtgtttcaaacctgccctatgaaagggaatgttcagttctgtgacttgaatgcaaacatcacaaagaagttcctgagaatgcttctccctagattttataagtaatcccgtttccaacgaaatcctcaaagctatccaaatatccactttcagattccacaaaaagagtgttgcaaaactgctctgtaaaaagaaaggttcatctctgttagttgaatacacacatcacaaacaagtttctgagaatgcttctgtctagtttttatgggaagatatttcctttttcaacataggcctcaaagcgctccaaatgtccacttccaggtagtgcagaaagagtgtttcaaacctgctatataacagggaatattctactctgtgacttgaatgaaaacatcacaaagcactttctgagaatgcttccgtctagattttatatgaagatattcccgtttccaacgaaatcttcctagctatctgaatatccacttgcagattctactaaaagaatgtttccaaaatgttgtatcaaaacaaaggttcaactctgttagttgaggacacacatcgcaaataagtttctgagaatgcttctgtctagtttttatttgaagatatttcctttctcaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttacatgtaatcccgtttccaacgaaatcctcaaagctatccaaatatccactttcagattccacaaaaagagtgtttcaaaactgctctgtaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgaatgaagacatcacaaagcattttctcagaatgcttccgtctagattttatatgaagatattcccgtttccaaggaaatcttcctagctatctaaatatcaacatgcagattctactaaaggaatgtttccaaaatgctgtatccacacaaaggttcaactctgttaattgaggacatacagcacaaagaagtttctgagaatgcttctgtctagaatttgtatgaagatatcccgtttccaaagaaatcctcaaaggtatccaaatatctacttccagattctacaaaaagactgtttcaaaacggctctgtcaaaagtaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaaagaaaccttcaaagctatccaaatatccacctgcagattctacaaaaagagtgtttccaaaatgttgtatcaaaacaaaggttcaagtctgttagttgaggacacacatcgcaaataagtttctgagaatgcttctgtctcgtttttatttgaagatatttcctttctcaccataggcctgaaagcgcttgaaatgtccgtttgcagatactacagaaagagtgtttcaaacatgctctatgaaagggaatgttcagttctgtgacgtgaatgcaaacatcacaaagaagttcctgagaatgcttctctctagattttacatgtaatcccgtttccaacgaaatcctcaaagctctccaaatatccactttcagattccacaaaaagagtgtttcaaaactgctctgtaaaaagaaaggttcatctctgttagttgaatacacacatcacaaacaagtttctgggaatgcttctgtctagtttctatgggaagatatttcctttttcaacataggcctcaaagcgctccaaatgtccacttccaggtagtgcacagagtgtttcaaacctgctctataaaagggaacattctactctgtgacttgaatgaagacatcacaaagcattttctcagaatgcttccgtctagattttatatgaagatattcccgtttccaaggaaatcttcctagctatctaaatatcaacatgcagaatctactaaaggaatgtttccaaaatgctgtatccacacaaaggttcaactctgttaattgaggacatacagcacaaagaagtttctgagaatgcttctgtctagaatttgtatgaagatatcccgtttccaaataaatcctcaaaggtatccaaatatctacttccagattctacaaaaagactgtttcaaaacggctctgtcaaaaggaaggttcaactctgttacttgagtacacacatcacaaggaagtttctgagaatgcttctgtctggtttttaggagaagatatttcctttttcaacataggcctcaaagcgctgcaaatgtccacttccaaatattacaaaaagagtgtttcaaacctgctctatgaagggaagtgttcaaatctatgagttgaatgcaaaaatcacagagaagtttctgagaatgcttctgtcttgattttatatgaagatattcccgtttccaacgaaaccttcaaagctatccaaatatccacctgcagattctacaaaaagagtgtttccaaaatgttgtatcaaaacaaaggttcaactctgttagttgaggacacacatcgcaaataagtttctgagaatgcttctgtctagtttttatttgaagatatttcctttctcaccataggcctgaaagcgcttgaaatgtccgtttgcagatactacagaaagagtgtttcaaacatgctctatgaaagggaatgttcagttctgtgacgtgactgcaaacatcacaaagaagttcctgagaatgcttctctctagattttacatgtaatcccgtttccaacgaaatcctcaaagctatccaaatatccactttcagattccacaaaaagagtgtttcaaaactgctctctaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacagagtgtttcaaacctgctctataaaagggaacattctactctgtgacttgaatgaagacatcacaaagcagtttctgagaatgcttccgtcgagattttatatgaagatattcccgtttccaaggaaatcttcctagctatctaaatatcaacatgcagattctactaaaggaatgtttccaaaatgctgtatccacacaaaggttcaactctgttaattgaggacatacagcacaaagaagtttctgagaatgcttctgtctagattttatatgaagatatcccgtttccaaagaaatcttcaaaggtatccaaatatctacttccagattctacaaaaagactgtttcaaaacggctctgtcaaaagtaaggttcaactctgttacttgagtacacacatcacaaggaagttcctgagaatgcttctgtctggtttttaggagaagatatttcctttttcaacataggcctcaaagcgctgcaaatgtccacttccaaatattacaaaaagagtgtttcaaacctgctctatgaagggaagtgttcaactctatgagttgaatgcaaacatcacagagaagtttctgagaatgcttctgtcttgattttatatgaagatattcccgtttccaacgaaaccttcaaagctatccaaatatccacctgcagattctacaaaaagagtgtttccaacatgttgtatcaaaacaaaggttcaagtctgttagttgaggacacacatcgcaaataagtttctgagaatgcttctgtctagtttttatttgaagatatttcctttctcaccataggcctgaaagcgcttgaaatgtccgtttgcagatactacagaaagagtgtttcaaacatgctctatgaaagggaatgttcagttctgtgacttgaatgcaaacatcacaaagaagttcctgagaatgcttctccctagatttcatatgtaatcccgtttccaacgaaatcctcaaagttatccaaatatccactttcagattccacaaaaagagtgtttcaaaactgctctgtaaaaagaaaggttcatctctgttagttgaatacacacatcacaaacaagtttctgagaatgcttctgtctagtttttatgggaagatatttcctttttcaccataggccacaaagcgctccaaaagtcatctcaagatactacaaaaacagtgtttcaaacttgctctctgaaagggaatgttcaactctctgacttgaaagcaaacatccaaagatgtttctgagaatgcttctctctagattttataagaagatattcccttttccaaagaaatcctcaaagatatcgaaatatctacttgcaggttcttcaaaaagagtgtttcaaaactgctctatcaaaagaaagcttcaaatctgttagttgagtccacacatcacaaacaagtttttgagaatgcttctgtctagtttttatgggaagatatttcccttttcaccatagacctcaaagcactccaaatgtccggttccagataatacaaaaagagtttttcaaacctgctctatgaatgggaatgttcaaatatgtgacttgaatgcaaacatcatgaagaagtttctgagaatgcttctgtctatattttatacgaagacattcccgtttccaacgaaatcctcaaagctatcgaaatatccactggcaaattctacaaaaggagtgtttcaaaactgctatatcaatagaaaggttcaacactgtttcttgaggagatacagcataaacaagtttatgagattgcttctatctcgttttcatgggaagatacttcctttttcaccatagacctcaaagcactccaaatgtcctcttgcagatactacaaaaagagtgtttcaaacctgctctatgaaagggaatgttcaactctgtgattagaatgcaaacatcacaaagtagtttctgagaattcttctgtctggtttttatatgaagatattcccgtttccaatgaaatcctgaaagctatccaaatatacacttgcagattctacaaaaagagtgtttcaaaagtgctctatgaaaagaaaggttcaactctgtttgttgagtacacacatcacaaacatgattctgagaatgcttctgtctagtttttatgagaagatatttcctttttcaacataggcctcaaagtgctccaaatgtcaacttccacatactaaaaaagactgtttcaaacctcctctatgaaagggaatgttcaattctgtgagttgaatacaaacattacaaagaagtttctgagaaggcttctgtctactttttatattgacatgcccgtttcgaaagaaatcctcaaagctatccaaatatccacttgcaggttctacaaaaagactgctttaaaactgctctatcaaaacaaaggttcaactctgttagttgggtacatacataacaaacaagtttctgagaatgattctttctagtttttatgagaagatagttcctttttcaccatagtcctcaaagcgctccagatgtccacttccagatactataaaaagagtgtgtcaaacctgctttatgaaaggcaatgttcacctctgtgacttgaatacaaacattacaaagaagtttctgagaatccttctgtctactttttatatggatattcccatttgcaatgaaatcctcaaagctatccaaatacgcacttgcagattctacaaaaagagtgtttcaaaacagttctatcaaaagaatggttcaactctcttacttgagtacgcacatcacaatcaagttttgagaatgcttctgtctagttttaatgggaagatatttgctttttcaccataggcctcaaatcactccaaatgtccacttccagatactacaaaaagagagtttcaaacgtgctctaagaaagggaatgttcagctctgtgatttgagtgcaaacatcacaaagaagtttctgagaatgcttctgtctagattttatatgaagatatcccgtttccaaagaaatcctcaaaggtatccaaatatctacttccagattctacaaaaagactgtttcaaaacggctctgtcaaaaggaaggttcaactctgttacttgagtacacacatcacaaggaagtttctgagaatgcttctgtctggtttttaggagaagatattacctttttcaacataggcctcaaagcgctgcaaatgcccacttccaaatattacaaaaagagtgtttcaaacctgctctatgaagggaagtgttcaaatctatgagttgaatgcaaaaatcacagagaagtttctgagaatgcttctgtcttgattttatatgaagatattcccgtttccaacgaaaccttcaaagctatccaaatatccacctgcagattctacaaaaagagtgtttccaaaatgttgtatcaaaacaaaggttcaactctgttagttgaggacacacatcgcaaataagtttctgagaatgcttctgtctagtttttatttgaagatatttcctttctcaccataggcctgaaagcgcttgaaatgtccgtttgcagatactacagaaagagtgtttcaaacatgctctatgaaagggaatgttcagttctgtgacgtgactgcaaacatcacaaagaagttcctgagaatgcttctctctagattttacatgtaatcccgtttccaacgaaatcctcaaagctatccaaatatccactttcagattccacaaaaagagtgtttcaaaactgctctctaaaaagaaaggttcatctctgttagttgaatacacacatcacaaacaagtttctgagaatgcttctgtctagtttctatgggaagatatttcctttttcaacataggcctcaaagcgctccaaatgtccacttccaggtagtgcacaaagagtgtttcaaacctgctctataaaagggaacattctactctgtgacttgaatgaagacatcacaaagcagtttctgggaatgcttccgtctagattgtatatgaagatattcccgtttccaaggaaatcttcctagctatctaaatatcaacttgcagagaagagcattaggacaaatatctaatgcatgggggcttaaaacctagatgacgggttcataggtgcagcaaaccaccatggcacatgtatgcctatgtaataaacctgcatgttctgcacatgtatcccagaccttaaagtaaaataaaatttacaaaagaaagatatgtaccctaaaaactataaaacattagtgaaatagaaagacatagaagaagacacaaataaatgggaaggtattttatgttcatagatcaaaagaattgacattgttaaaatgctcgagaggccaaggcaggcagatcatgaggtcaggagatccagaccatcctggctaacatggtgaaaccccgtctctactaaaaatacaaaaaattagccaggcgtggtggcggatgcctgtagtcccagctactcaggaggctgaggcagaagaatggcaaaaacctgggaggcagagcttgcagattgcgccactgcactccagcctgggtgacagtgagtctccatctaaaaaaaaaaagtcataatacccaaagtgataaagagattcaatgcaatgcctatcaaaatttcaatgtattccacaatagtcagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccaactctcgccggctgtccctaggagtccacgggccgtccggggccccccccaggcctggcgggaccaggatgctgccctgtcacctgccccccagccccacacaacgcccccacccacccgaacatccagtctgactggagacagccggatgccctctgaccccgggcccgaggcgggcagtggctggccgggcctcctcatgtcctgcctgaagggtccccatgtcatcctcaagatggaggccatgaagattgtccaccctgaaaagttccctgagctaccggctgccccctgcttcccgcctgctccccggcccaccccaactctggcacccaagcgtgcctggccctcagacacagagatcattgtcaaccaggcctgtgggggggacatgcctgccttggaaggggcaccccataccccgccactgccacggcggccccgtaagggaagctcggagctgggctttccccgcgtggccccagaggatgaggtcattgtgaatcagtacgtgattcggcctggcccctcggcctcggcggcttcttcggcggcggcaggcgagcccctggagtgccccacctgtgggcactcctacaatgtcacccagcggaggccccgcgtgctgtcctgcctgcactctgtgtgtgagcagtgcctgcagattctctacgagtcctgccccaagtacaagttcatctcctgccccacctgccgccgtgagactgtgctcttcaccgactacggcctggccgcgctggctgtcaacacgtccatcctgagccgcctgccgcctgaggcgctgacggccccatccgggggtcagtggggggctgagcccgagggcagctgctaccagaccttccggcagtactgtggggccgcgtgcacctgccacgtgcggaacccactgtccgcctgctccatcatgtagtagcgcctgcctgcccgccactgcccgctgagcctcgctcgctgcttcttcagggacccggccctgccctgccgcccgctgacccttccttccccaccatggcttccggccccaccccgagtggcattgtcgctgcagccaactttgccattaaaactctttgccaaagtttgcacctgttcctggactgaagcttgctcctgtgggctgtgctcaggcctgggcctagggtgggcacccagggctgcaacccagagagggcccagcttggagctgccagagagaggcccagcgctgctcgggttgggcctgccctgcgcactgggggccaggctgggctgtgcatgcagctcaggagggccgggtgggctgtgtcggtgcaaacccccacacgtacagagtgggctgcttgtgtgcgcctggcaggactacctggtgggtgtgcagagacaccccagctgggcagagaggacattttcaatggtgtgggggtgcctgtgtgggggacaactcggttgatttccctcctggtgcccatctggacctgagcacccacctgggtcttccagggttgtgtgggagtagcctttgggcatgtgcaggagttagggacaaagactggctgaaatggtggtaggggaataaggacccagcgcctcctgtctggcacctggaccacttgggtgggaggaagagcccgccccaggctgggtgcggtgtctcacgcctgtaatcccagcactttgggaggccgaggcggatggatcacctgaggtcaggagttcaaaaccaggctggccaacgtggtgaaacctcttctctactaaaaatacaaaaaaaattatccaggtgtggtggtgcatgtctgtaatcccagctattcaggagggtgaggcaaaagaattgcttgaactcgggaggtggaggttgcagtgagcagagatcgtgccactgcactctagcctgagtgactaagtgacgctctgtctcaaaaaaaaaaaaaaaaaaaaaaaagcccacccagatggtgaagatggggtaacaaagacaagtagtaacaatggcatccccaggagctggtttattgaaagctgcttcacgttccaggatcagtcctccatctctcgctgggccacctgatgtctccatcccaggtgtggtgacatgagggtgtgcaggggcagagcttatgttccaaggcctgggtgggcccttgtcccctgcaacacaggccagcgccaacccccacctggtctgggcctgatcaagtggggagaggagcctttgcaggctgaattttcgcagcatggacccctcccccggctggcctgaccttcagggacacacactggcccttatctgaacacagggtgggcggagtccctgccctctccaaggaactgactcactgctgtatctctgtttgctttcatgcctgctgtgctcagctggccctcggaggggaagtgtggccggcgtcagcccgtggccagtacggtgcccgtctgccgcagggtgaatggggtcctgctcacagactttcctgctgggctggcctcctccaggagctgtccttgggcgctggtgtccttgggttcagctagtgtctgggcagcagtgcagccatggactctggcagggtcaggcctctgggtagccctggttgtgggttcagcaatgggaggtcttgattgaaggccactgccctggacccaaccttgggtttttccagcctggtcatcaggcctcacagcacccaggcatggggacgtgggccagtctgggccccctggcctgttggcggcggggctgtcctgggctctgctcagcggccagagcggtccaggagcacgaagagcagtcccagcagcaggagcggcgtgaagaccagcagcagccccagaagctcaagggccagcaggctcagcagcgccaggcggcgggcacagggtccccgctcccgcagggtccagagccgggcacccaggcagggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggccagctcggctgccacctcctcgccttgtctctgccctgcccggaacaccagggcgccccaagctggcctcaatgctcactccctgcctggcatcctggcttacagtggtgaggcagtacctgcgcagagcagcctagcgcctggtgctcagccccagagaggcccccaccctgctcagcagaccaggagacggcccagcacccacggccccagcctcctcctgcctcatcctcaaggcctggtccaggccacctcctcccggaagcccaggccccgaggcaggacaggaggtgtgcaggaattagatatttcctgggaaactagaaaaacatcccagctgaggttgggaggtgaatcaccagtgggcagggcgtggtcctggctgtctgggctctcctgtcccaaccttccactccctgaaacctgcagcacctgctgcacccaccaccctcttgtcgacacgctccttctcttggaggcctttcctggggtccccccagttccatgcgctgtatcctcctgctgtccgacccatggactgaccccagctcacagtctcagtctcggccccagggagcgcaggtcagctcaaatccagacctggctcagctagggctgtggacacgctgcaagccctcgtgcagtctctgggcagacccgggacttgcaggccaggggaaagtgtggacgtcatgaggcagtggcatccctgtccttgcagtgtccacagtgactgtgtgtgtgtgttctcgggtccacataaaggggcagatgccctgtgtccagctacaaccccctcccaaaggagcctgcagcaaagaagaattgctgggaggaagatcaccctgctttattgcctgggccttaaggtaatcaggggtgtccctctccagccaggacctgggattccgtttcaggagctcgggctgaacggccaccttcctggtgggtctgagccccagtgcctggtgtgaaggggcagacgcccatgacaacagccaccccgcatgtcccggcatgtcccggcactgtgtgagccacatttgctgaagtctgggtcctggccctggcagggtgggctgggctaggagatgacacagcagcagcagctgtggcagcggcagaagggggggcagtggcagcagtggcagcaggggcagcagcagcagtggtgggcgatgtcatccccgcgccccacgggcggagggccagcgtaggtcagtccggcctggcgctgactgctgctgtaggggttgccaggctgctgccaggcctgctggttctggatgggggcagccccctggttacccttggcgcccttgggccctgggacctcggtcggctgcaagaggtgggttggctctggggcacagggccccactggcaggggctgcatctccgaggatgaggaacaggtggaagccacctctaactgctgccccaggtcaggccgcaggtgagcccgggggatgctgatgtgggcatatgggttcttgacgaccatctcttgggggtccatggtccagcctgcaggggtgggcagagaagacagacatgaactcagtggagtgggatggctgcccacgagcctgcggcccaggaaagcccccaccaggagcagcgtgcctcgtccaagctcagcatccccaaggcatcagtgccggggtgccatcacctccaaatgtgtgtgcaaggctagtgtcatgggcgtgagccaagtgtgagcaagcagcaagggccggtgtctcccagctgccacccctgccagggatcctccccctcccctggtggcattggtcctgggatggagctgggaatggggtcggggaggctgagagatgggagagaagggggctgaccctgcagtgcccctgagttcagggcagtcccggcggccaagggcttacctgtggtggcaacacggcagtctgtcctctcggtcttctgagctctaggtcccagtgcctgagttgagcgactggcagccgccttttccctccttgggaggggcggggccatggggcggggctcagagatggggttcccaagatcccaagaggccccagcaactggagcacgacagctggcccagccctcgtcctcaggtgggtggcagcccaggcctgggctctgaggggcactgccaaaccagtgactcagcccctcacatccggggcatggcctgggccctaaagggcatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactcagacctctgaggtccatcccaagggctctcacactcggccctctgaggttccagtgtcgctgagacacatccccctccttccgtggctgcaggacctcgagccaacagggtccagatcctctggttccacaccgtgccttccacggtgtcctcccagcttgatcagaggcccccccaaggaacctactgccccctccctacctggatcccaggtggcctgtgtgcgtggtcttcaccgcccacccacctccccttcccgtggccaagcatggaggctagcagacagggaggccctggccttgtcagcccacagctctgaccctggccctggaccacccctggcctcccgggacctcactgcctcatcagctgcctctctgggccacgctatgcgagcaaatgtacccagcctcttgcccccgagaccctccctagcgccctgctgttgagacacccttgcttcctgaatcccaaaagactctcttccctgctccgtttggtgaacttcctccttcccgagaaaagggttctggagagaacattcttgtgacttttccctcactcgactggcatgcggctgggtctgtcctgggcttggcaccaccactgaaaagccagggccccacttgctgcccttggggtgtgtagggcactctgtccccagaggctaaacccacagtgacatgccccgggggtagccctttcattctcagcagggcccttcctgggcatggggctctctggccgcagaccccgctctagacatcattactttcctggataacttcctctccaccattgtcttctcattctgaggccactggaattatcttcgaattttggtatctgcttccttccattttctatcttgctttttgtcatactttctagaaggatttctcatctttttttgagatggagtctcactctgtagcccaggctggagtgcaatggcgcgacctcagctcaccgcaacctccgcctcccaggttcaagtgattctcctgcctcagcctcccaagtagctgggattacaggtgcgtgccaccatgcccggctaatttttgtatttttagtagagacagggtttcaccatgttggccaagctggtctcgaactcctaacctcaagtgacccacccacctcggcctcccaaagtgttggtattacaggcgtgagccgtcgtgcccggccttttttgttgttgagacagggtctcattctgtcatccaagctggaatgcagtcttgaaatcacagctcactgcagccttgaccttctgggctcaagcgatcctccaacctcagcctcccaagtagtggggattacaggtgtgtgtcaccacgcccagctaatttattattattttgtttgtagagactgggtttcgtcatgttgcccaggctggtctcaaactcctgggctcaagcgatcctcccacaccttggcttctcaaagcgctgggattccaggcttgagccactgtgcccagcgtcttctaatcttttaaagttttttcatgtccatttaaagaactatttctggccaggtgtggtggctcacacctgcaaacctagcactttgggaggatgaggcaggcagactgcttgagcccagaagcttgagaccccatctctacaaaaaatacaaaaaaaaaaaaaaattagttgcatgtggtggtgcgcacctgcagtccctgctacccaggaggctgaggtgggaggatcacctgagtctggaaggtcagggggcagtgagccgttgatggctgccactgcactccagcctgggcaacagagcgagagctctgtctccagaaagaaaaagaaaaagagaaagagaaaaaactgtttcctgttcctgagtctccagctttgccccgtgggggtaacatccttggctgcttcagcctgtgcccgtctctgcctgttatgcgggtctttcctcgggtggggtgtggttctttctggtgcatgttttcacccacgctggagtgcagtggtgtgatctgggctcagtgcaacctccacttcctgggttcaagtgattctcctgcctcagcctcctgagtagctgagattacaggcatgcaccaatacacccagctaattttttgtatttttagtagagatggggtttcgtcatgttggccaggctggtctcaaactcctgacctcaggtgatccacccgcctcggcctcccaaagtgttgggattacaggcttgggccagcgcgcccagcgccccatgggtttcttcaccagacaggcagggacctggtcacttggcctttcactgtggttcctctgttttctcctgtctgctgctgggggcacctgcctcacctacagcatcctcagcaaggagccagggtcttcctgtttcgctgtggatggagagccagggtcctctggtttagctatggatagccactaagactcgcccctgcctctgaggccatgggccctgggtccacagcctcttcaaggagctcccagttcccgctgtgggcattagctgccccctccaactcctggtcttctctgtgggtgcccacacttgggactcttcgtttcctcgttgacctgaatcccggcattagcaccagcttcctgccactggctgactgaatgcccagcccagcctcagtccctctcctctcccatgctctggggcttccctatcccaccattcccctcccgtgcctgtgctccactctgaaaccccttctcttccatcccactctatctgagacccctcgacctatgttcagctctcccccaagccgctgcacatcccctgccatacctactcagtcttcagcctctttctcctgtctctcccctgccagcaattaaacatgccaagttttggccgggtgtggtggctcacgcctgtaatcccaccactttgggaggctgaggcaggtggatcacgaggtcaggagattgagatcatcctggctaacacggtgaaacccgatctctactaaaaaaatacaaaaaattagctgggcgtggtggcggcgcctgtagtcccatctacttgggaggctgaggcgggagaatggcgcgaacccgggaggcagtgcttgcagtgagctgggatcaacgccactgttgtcggggaaagtagaatatgtcacaggagcactgataaggggcatcgagccttatctcacccaaccttggggcccaggcagaggtttctggaaaaaaagagtgtaagctgagtcacggaaggatgcgtgagggctagtcaggcaccgaggaagaaggagcagtcagcgcagaggaaaaagatgatttggtttgtgtgaaaagtggaaagcagatcagggtggccaagctgaggagtacactgaggcaagaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgacctggcctccattggggacggccccccggacacaccccggtgcctcgcgccgctcactggcagaccccacttccgcctctgcgctctcagctcccggcgtccctgggggtagccgggtgcgcggcccctggaccctgcgccccgagtgaccttggctgagcttgggacttcctcatgctgccagcaccgaggccgcctgttccgtccgctgagagcgcggtgcaggaagggcgctgctccaggaccgaaggcacccgtgtccgtggacggtgcacaggccacactctggcccggaccctgctttcaccaggggtcctccgacctccggcaggtgcctgcggggcttggaaatgccaattctggagccccgagcagccccaacgaaccagtttctcagaaatccctagtttttataggctgcccaggtgggagcctcttaacccaaccttgccatccgtggtccccaaaaagcatctgcaggagcaggcacaaaggaagcagcctctcccgccacacgcaagcaggttcaccagggcagggccctgcatgcttggagagctctccaatgcattcagagccaaaaaaaaaaaaaaaagccagggtaacggtgggccccatagggccgacccctgtgtctgattattccaccctgctgccacgttaaggttactcctctcccatcggttgaacgtcccctcatcaaggctccggataccatgaccctgagggcacagcctcccggctgacaagtcccttctgccccagggagggcttcagagtgcttccacagcctttcaagcctgcagacaatagggagatcgcttggagtcacggggagaaggggaattggagtgcacggacatcaccttctttccatcacctgccctgcagtcagcagcctgctcagtagacactgctgtttcccacaccaaggtcgcctgggtctctgcaatgatgcagaacagattttttttttttaacttggggatgcccttctcagcttctgtgccccatgacagtctgcagcagccgctagcttaatgcttgccttattctcctgccactccattaagctggagaaaataaactttttctttttcttttttttttgagatagagtcttgctcttgtcacccaggctggagtgcagtggcacgatctcggctcactacaacctccgcctccaggattcaagcgattctcctgccttcgcctcccaagtagctggggttacaggtgcccaccacaacgcccggctaatttttgtatttttagtagagacgggatttcgccatgttggccaggctggtctcgaactcctggcctcatgatctgcctgccttggcctcccaaactgctgggattacaggcgtgagccactgggcctggccagaataaactttcatttcagctttccagaagccaagtgtctcctcccttagggccctcctcaaatcacctttctaaaggaagcatctgatgttcatcacttctaccctagtagggttgcccaattctgaactaccaaaataaaacagggaacacacaaaacacaaaatctagaaataaataacattacgaggaaactcactcccactgttcagcttgaatctggctttgacaaaagttatgccaatcccaggctggacacagtgtcgtagcaacaaaccagataagctgcctccaacgcaagcccctccatggtttacacaactaagcatacacgccaggcagaggctgacaccgcactccgctggccaggctgatgcatgagagcagaggtcagcacacctgttctgtaacgagccagataggaaatttttttttttttttttttttgagacagagtctcgctctgtcgcccacgctggagtgcagtggtgctatctcggctgactgcaatctctgcctcccaggttcaagcaattctcctgcctcagcctcctgagtagctgggattacaggcatgcgccaccatgcccagctaattttagtatttttagtagagacggggtttcaccacgttggtcaggctggtctcaaactcctgacctcgtgatctgcccgcctccgcctcccaaagtgctgggattacaagcgtgagccaccgcatctggccccagacaggaaatattttagcccactggtttttgccagggacaattttgttccccagggcccttagcaatgtctggataaacatctgcttgtcacaagtgaaggctgctactggcatctacccaggagaggcaggagcactgcgaaacagactgcatcctcactagagaatcttctggccccaaaggccaagagtgccaattaagagaccttggactctgagggtcatatccactctctgtcacaagttctgcttttgtttttttttttgtttgtttgtttttttctgagacagagtctcgctctgttggccaggctggagtgcagtggcgttgtctcggctcactgcaagctccgcctcccgggttcacgccattctcctgcctcagcctcccaagtagctgggactataggcacccgccaccacgcccggctaatttttgtatttttagtagagacagggtttcaccgtgttagccaggatagtttcgatctcctgatcttgtgatccacccacctcggcctcccaaagtgctgggattacaggcgtgagccaccacgcctggcctgcttttgcttttaatcatttaggggtgtaaaaaccatcctcagctcaagggtcatacaaaaacaggccttaggacattgtttgctgatccctgctctacagagtgccaacaaggcccacaaagaccacactctggcaagaagtcatgggctctggggtcacaaactattcaatgggtctttaacatgagcccagattgttgtcttcatacagggtgggggggggggtgcctgagttacccacctcctagagcaggaaggagggattctccagaacaagtgattcccaccaccaccatccactaagctctagccacaggtttcaatccatttaaaaccgcagctctgtaaccagctacaccacgtagcagagagtatctcaatattcatcctatttaacccttgagggttacaggcaaccactattcatttcaggaaaacattctcttactttatttgcatctcagcaaaggttctcatgtggcacctgactggcatcaaaccaaagttcgtaggccaacaaagatgggccactcacaagcttcccatttgtagatctcagtgcctatgagtatctgacacctgttcctctcttcagtctcttagggaggcttaaatctgtctcaggtgtgctaagagtgccagcccaaggtggtcaaaagtccacaaaactgcagtctttgctgggatagtaagccaagcagtgcctggacagcagagttcttttcttgggcaacagataaccagacaggactctaatcgtgctcttattcaacattcttctgtctctgcctagactggaataaaaagccaatctctctcgtggcacagggaaggagatacaagctcgtttacatgtgatagatctaacaaaggcatctaccgaagtctggtctggatagacggcacagggagctcttaggtcagcgctgctggttggaggacattcctgagtccagctttgcagcctttgtgcaacagtactttcccaggatccacaggaaatactcagagtccacctggacattttacttatattcagtttccaagtgtcagaggggttcaggactgtctggcctggggggcctcctcatgacctcaattcaggattatctactcaaagcattaaacaaaaggaaatacattttcaggatgaaggctgctcttttaagccctgctgaagaaaccatttcaaacaggattggaatagggaaacccggcactcagctcggcgcaagccggcggtgccttcagactagagagcctctcctccggtgcgctgcaagtagggcctcggctcgaggtcaacattctagttgtccagcgctccctctccggcacctcggtgaggctagttgacccgacaggcgcggatcatgagcagctgcaggagaatgaagagcggggacgtaatgaggccgaaccagagctcccgagtctgctccgccagcttctggcacaacagcatctcgaagacgaacttgagactcaggaccgtaagtacccagaaaaggcggagcaccgccagccgcttctctccatcctggaagaggcgcacggacacgatggtggtgaagtaggtgctgagcccgtcagcggcgaagaaaggcacgaacacgttccaccaggagaggcccgggaccaggccatccacacgcagtgccagcagcacagagaacaccaacagggccagcaggtgcacgaagatctcgaaggtggcgaagcctagccactgcaccagctcccggagcgagaagagcatcgcgcccgttgagcgcgggccggggcccggccgagcgtgccacccgcggggctgcgtctcctctccccgtggccctcgcccgcgcctgccgcggctgctgcgagcgagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgagggtgatgtcccaggaaggaagctccacgcaggcctgtagagcacagcagggtctggctcctgtgggcagggtgggacctggtctccctagacgctggaccagccctgcctcctcccggtgcccatcatcctgcaggctggacctgggccctgccttttggtcagataggtccagttgtattctgcccccatcctacccacctgcctgttcccctgagaccctcccctcaccccctgctgtggggctagcctagaggtcgaggactctgactcagagtttcctccggctgtagaacttctggaggtttatattccggaagaacctgccctccactgccctctgtcagatggactttgccgtcctgggcctcggggactcctcatacgccaagtgagtaggggatgggacagtgggcggacggaacagttctgggggtcgagcaacaggtgtgctggcagaggaccgagaccagcttccagggtcggcccctgcgcgcctcagggccctcgcagtggtactggcttctccacaacgctccctggtgggcaccccaggcttcacgctgcggggagggcacagaggggagcaggcagggtggcaaagggctgggctccagccacgctgacgtcacacaggcctacctggcgccggtccccacttttacaaaaaggcgttctgtgaagtgttgacgactttgagcctggaggaggaccccgtatgctcctgccaccccagaggccacctctgccttttctcctgggcattttcacagtgctcctctgcaccctaagcaaggagtggcatgttcagtgtgcaaatggcatctttagaccccacaacggtgaaaaccccgactgtccacgtagggcccaggtccgctgagcaccgagcatcaaaagccgtttgcatagccaggtgtcagtcatttcagatgaaaaagaacgggaagatcggagacagctccccccggttctgccgggaggttttgttccgtgcgtgacgtaggtccgtgcatgacgttgtttcctgcgtgacgttgttctgtgtgggacgcagtgttcgttcaagagagggagggaggccgctgccgacagcgttcccagggaggagcgtgacccagagccagtcatgcctcggaaccagagtgagaagagaaactgacccccgggaagatgcctggctctctccccagcacagagtttctcagctgaggagtgacccacatcttggctgggggcctggaggcctcagctgcctcaggtccctgcccagggatgagggcccatcagtgggacgaggccgcctgctcccacccacacaggctcattctctgcgagcagaggacctgctgcttggcaccctggcagctgccctggtctcggcagcccctggcgtgtggaggccctgccccctcctagggtgcggccagcgtggagtgtgttttccacccgagggaggccctccccaggctccactcttcgcccgggctccactctcccgggttccactctgcctgggcaccactctccgcccgggctccagcccaggaccagcctcactgtctccacaggttcaacttcgtggccaagaagctgcaccgacggctactgcagcttgggggcagcgccctcctgcccgtgtgcctgggcgatgaccagcatgagctggggtgagtctgcgggcgtagtacccacctccacatctggtctagccacacacaaggtcctctcaagccaacccacgttctccctcccaggcccgaccctgcttttacccccttccctacacaccccaaaaacacaacgttctgggtcattttatcctcccttgtgccagccctcttttaaaatcgcctagaacctttcaccttataata

SEQ ID NO: 207 - DNA, 8017 bp, Homo sapiens
taaacctttgtcacaacattcccagtgatcgttttccatcttggggatgaggattgaattctcaggtcggggaaaacagaaaatagagattagggtgggaaagcacaggcgagaaagctctggggaacagacaggatattgaagctgaaacagagcacatttcagaagggggctggagattagggataggattatggcaaggacaataataataacgtatagctcacttattctgtgccctactaagtgttttgcatgtcatctttctctgtcatgggttaaaatgtatgtcaccatttcccaaaattcccagcacccaggctgggaattgactggggatctgactgtgaccttacctggagatagatatgtctttacagagataatcaagttaaaatgaggtatttagggtgggccctaatccaagatgattagggtccttagaaaaaggggaaatttggagacagacgtgcatatcaagggaatgccacatggcatgaacatagccatctacagacaaaagagaggggcccagaacacatcctccctcacagccctccaaggacacccccctgccaacaccttgatctcaaacttccagcctccagaactgtgagacactaaaatcctgtttttttaaaagcatagtttataatactttgttacagcagtcctagcaaacaaatacaagttcatcaagccacggctaccattctagaaggccaactctgttgttatctccattttacagaaactcaggtttgcagaggctgagtaactcgcctacatcacacagctaggaagaagaggagttggcatttcaaacaaggtttgcctgattaccaagagatcttaaccactaattttaaccatgctgcatggggtgctgggggttggggagaggttgaatggggcacagcacctctcattacatctggtaacttaaagcacaggccctgactttgcccacctctcaaaggacctccccctctcccacacatacatccctttgctctgcccagggttggtcctggggagtggggagcttggcgactgaggactgggtggactgtagggtggacactatccccctaggaggaatctcatttcccctccagcactaaggaaacaatgcggctgtcagcccgtcccgggaaaagcctgctggtcccaatggtgcccccgccccccagcaggcactgtggttggcctgactcttctcattaggcctggggtgacaggacgtatcgcagccagcagcttgctgcagcatctcctgcctcgagcaccagagctctgctggggagacgcagtggctgccaaccctgactcaccttgtctgctcctggagcctcaccctccctggctaattatccccaaaacctgcactgtccagaggccttcggcacagagacatccacactcttggccttttgtgggcaggaaaggcctgctgaggctgttttaagaaagcagaattgtcagagcccaagaggtaattagtatttaagaggcacaagttggcaaggttaaaagctgagaaataaacacacacacacacacacacacacacatacactccatttcaaataattcttaaaagagtaaacaggaagatatggcccctgcctgggaaaccattaagaaagaaagatagaattccacaccacagatgacctcaggcactgctgtctggacagaggctcttccgcagtgccaggacagggctacttctaggctgtgaagctctcatctgcccccaaaacctcctcttcctccactcctccttgtctctgccatcatccttcctgccacaccactgaaaacctcagaatctcccactgctctgtccactccaacccaatgtgctggggatttgtcctttgccatgtaactcttatccagccctgcctctccagcccacagtccctgccctagttccagcctggaccactataacacctcctttctggtcaccccacattggatccatcttccaaacaaaggtttgattgtgtcatctttctacttaaaactctttcctggcacctcaccgccaagatgccccgtgggagagtgcattttcccttgacctctggcactggagtggaactgcagctccaccttgcttccatatggccctgggtaaattactaaatctctccaaactcagcttcctcatctgtaaaatgggtgtaaccatacttacctcaaggaactgttgtgagtggtgagcaatcagcaccttgaacctgttcatgactcagtaaagtgtggcttttatgattattaatccaagaaggagaacgggattgtccatggttacctggtaggttagtagcaagtccaagacctcgaaccctcagggcactgcagagcaaaatatagcaggccctcgataagtatctgttgggtgagtggctgtcaatcaatccataaatcaatcacttgatcccagccggccctaggtaataagttccacgagcctattaacctcctctcaagacaaaggtaaggaaacccagcttccttttgtggcccgtgcttatttctcaagactcaaggaagctccctggtgtttacatctgggattgtatgaacaagccttaactggctcttttcagacgtcctaatcctgatgtggactcagctttgcttttcagactgcgaaggcactggccctctggtttcccacatgagagtgtctttctctgagtggcagcccagaaaaggcttcctgagttcctgcagctgacccagctgggatttcaggtggcccagacagttggaccagaatttctatctgtagtaggataaattctacctgttgagggtgactctgaaattttttgtttgtttgtttgtttgtttggtaggaagttgaggtctggctatattgcccaggctaatctcaaactcctgtgctaaagtaatcctccccctcagcctccagagtagctggaattacagacataagctaccatgcccagctcagaacccctttaaaatgtgtgaagtcaggagccctgtgggaactggcttcaaccctgccactgtgaatgagcccagaccaacaaccgtccactcaaaactacaggcttactgctttgttgccttagttagaaacccaagcctcttcctgacaccttttctggttttttgttttttgtttttgttttttgtttgtttgttttgagatggagtcttgctcttgtcacccagactggagtgcaatggtatgatctcggctcactgcaacctctgcccctcaggttcaagaaattctcctgcctcagcctcccgaggagctggattacaggcaccagccaccacacctggctaattttttgtatttttaatagagacagggttttgccatgttggccagtctggtcttgaactcctcactacaggtgatccacctgcctcagcctctcaaaatgctgggattgcaggaatgagccacggtgcccagccaatctttcttaacccaccttctacaccaagccctacccatcccatcatccaaatgtgtcatttccctcccacaccactaacagcaaccatcgatgtttacgccaccctcgtctccctcctgggctgttccaagagcctccttcctgacctccctgcttccagcttcaccccttgctccaaccaaaacaatcttgctaacacacaaatctacctcatcactcccctgcttaaaaccttgcaaaggcttctcattgcacccaggaggaagtccaaaagccttaactggatttataacatcttaacgatctgcccctccctttccagtccaatctgatcagactcaacatgcttgcttttagagtgccagattcgttccgtcctctgggccttgacaagtgctattccctctgcctaaaacacttttccccctcttcttcacttgctgagtttattcaacaaattcattcaagaactacctacagaatgccagggttgtatcaggcgatctccttatgaggttcggagtctcatggaagagtcatagttacctcaagggacaaatcaaataacacagattaatcaatcattacaaattgagatcagtgccatggaggggaatgacagagaggcctaaccttggcatcttggaaggcttccctgaagaaggaatctttaagctgagaggtgaagtggttgttcagtactggcaataggaaccggggactgtgtggccccattctccaccaagtggaacatgactgcccactatgggagtaaaggaggctagcaggcaagagtgagtgtgtccatggctcctggcctgaggctcctgcaactgcagttttgcctcttattttcccagtcactccatttttctctcatgggctagtcatgagcaaaccctgactaataaaatgacaaggcttccagcagatggtagcatggcctttgaaatcatagagacttggcctcgattcctggaccctccacttgtcaccgtgtggccctgggccagttacttcccctgtgtaagcatgagttacctcatctgtaaaatgggacaaaaattcctccctttgcaaggttctcctaaggaggaaatgagatggaaggtgtgtcctttcaaaaatgaactgcaaaagaattgaaagcctcgtgccatttgcagttcaagtaggggtaaatgggtgatggggtccctcatgctttgggccaaaatctaccaggctggctgggctcaaagagaccaaactagagaattcaaaatttctcactgcagaaaaaagccagcactaccatttaaactgttgatgtattcttttaaaattgactttctgtcagagacaagtataattgaatccccggacccttcgatattaaagaggtttctggactcatttcccccacccctagcccaccaacaataaaagaaaaacagagttgtattaaaaatatttaatattcggcacttgatcctacctccaaacagaaacacctaactatgggccagagagtggagaaagagcagatggctgataaggtctcgcatggtctggccccttcccatagggcccaatagatgacacccctttcttaccctgccttaatatagaacttatgaagtcctgcagatggagatcaagacatcagctgcgttgttgaaagtatattgttgtggactgtggcttaagtgtcaacactgggtttcctaagtccacctcatcatcaagcatcctcacacgtccagcctcaaggaacggtaggactgtagacttcaccctgcaggggcagaatgtttactgccaagagacccctaacggagtccagaatacccagcacctcgtctcaaactcactagtcagaataatcacttgtcttccctgggaggagagagggaaggagcagagagagagaggccaggaaagaccagaaaaagaaaataagccgttatccctaacttcattcactctatctgtgccctgtccaaactggtcttcttttcagctctgcaaaaatgccatgcttctttgcagccagggcctatgtacatgctttactttttttttttttttttttttgtatatttggaacactctcttctattctcgttttgtctggtgacccttattcatcttacaagtttctgcttaaacattatttccctaggaaagccttcctgatctcccacacaaggtcatgtccccctgttaaatgctctcctagcttctgtattccctctatgtcacatttgtcgcatttgtcatgattttaagtacataattatttgtgtgattatctgtccaatgtcggcttgctcaagaagactcgagggcagagctgtgcttgtgaggatgaccactgtatgtatcctggcatcagtctcactaccaccacacagtagaggctcaagatattaattaaaggaagtaagtaacagtaacacacaaagccattttaagcactttgcatacattaatctttttaatgtttaaagtacttctgttttacaagtggggaaaccaaggcacaaagaggttagataattagctcaaggtcatacagctaacgagcagagctgggatttgaacacaggcagtcagactccagcagcagtgctactcacaactgcactgaagtgcatcttgaggaggagagatgggagaagtgtgtgccatgcacgagagattggggagggtcctgatgcacagacgggcttttcttgcacaagagtctagccagaggaaaacaaagatgggagaaaagacagaaaagaacgttccatctgccacattgaggtaagaagtcagggatgcctaaggggatgtccggggtgaaatgcaggggcagagaaagccccaaagctcactgctgcctctggaacattaagttaagccatcaactcccgccctggtcctgggagtcggtatatgagtttggccagttgccatgacaattggctctcttggcccttcagggtggtccagctatggggacccctgcctccctggggttctcagcacacctgacagataatttccacctcatgtcatgatctacatgaaacacatcacagtgcctgatagagtaaaagtgtgatacatgtttttaaaacctctcagaagagcctgcatgggagtcacagccctgaccatgggtgcctctccctggaggcaatgtcccttggggggctaattgttcattaactccaccagtgaagtcctacagagatggaatgctgccaccccacgtgcccacacctgcgtagtcagcatctggcaggctcattgttttaagtgatgagcaattgtcattttctgtcgcctccatgataaatcactttaagaactcctttctctcgacagcataagtaattacagccctggtatctggggccctggcaccgattagaagggaagcaaactacaccggaactgatgctgactcatttttctttctcaaaagggcctagaggccacaggttcagaaccatttggctggacccttcccgggctgaaagctgactccctccaccccacagcactgccagagctgaagcctggagacagagccctccactcccaccctgcaaagcccctcacctccttttctctagctgtctttaagacatgattcccaagtgaaccaatgattaggaggaaaatgtattgtgctataacagagagaaataattaggttagataataagaaagggaagtgtaccttgtaagaggttctgctgtggttatgcattcttgggaatatttgatctattatgtttttttcttggtagacatgggatgtattgaatcagtagaataaataaacctcttggtaagcaagaaaaaacatacctcagatggtaagaatcttggtgacccagaaatgacaatgaggaaaagatcggatgatcctgacattctcataacctgagaaggagatcctggaacagtacttgggagagcattgcacttaggattaaagaattaaagcacacgggggcagacttgagtggtagaaaggatatatgaaacccatgtgctcaagaatgtcctgggtacggtacctgctgtcacttctaccaccaatggttgccaccatcataagcagttgtcagtgaattcacatcatgcacctgtctgcctatctgctggtgtcaccacatgagagaaacctctggccaagagttaaggaaggccattctcctggcagcttctgtgaaccagcctgggtgccagctagcctgacagcctcctgtcttgattactctccctgcccctttaccaatagcctgagagtcatgcgcttttgcagaagttattggctagggagtcagcaaacaatcctgggcaatgacaccaaaaataaaaggatggaagatgttcatgattaaataaattttggaaatgctgcatactttagccttctctgggagattcacagtgcacattagcattctaaatgctctgagaagccctgcaagaaataaccaggctagctttatttaacccattgtttcctgcactgctctgatcaaggtacc

SEQ ID NO: 208 - DNA, 6034 bp, Homo sapiens
ttggatccatcttccaaacaaaggtttgattgtgtcatctttctacttaaaactctttcctggcacctcaccgccaagatgccccgtgggagagtgcattttcccttgacctctggcactggagtggaactgcagctccaccttgcttccatatggccctgggtaaattactaaatctctccaaactcagcttcctcatctgtaaaatgggtgtaaccatacttacctcaaggaactgttgtgagtggtgagcaatcagcaccttgaacctgttcatgactcagtaaagtgtggcttttatgattattaatccaagaaggagaacgggattgtccatggttacctggtaggttagtagcaagtccaagacctcgaaccctcagggcactgcagagcaaaatatagcaggccctcgataagtatctgttgggtgagtggctgtcaatcaatccataaatcaatcacttgatcccagccggccctaggtaataagttccacgagcctattaacctcctctcaagacaaaggtaaggaaacccagcttccttttgtggcccgtgcttatttctcaagactcaaggaagctccctggtgtttacatctgggattgtatgaacaagccttaactggctcttttcagacgtcctaatcctgatgtggactcagctttgcttttcagactgcgaaggcactggccctctggtttcccacatgagagtgtctttctctgagtggcagcccagaaaaggcttcctgagttcctgcagctgacccagctgggatttcaggtggcccagacagttggaccagaatttctatctgtagtaggataaattctacctgttgagggtgactctgaaattttttgtttgtttgtttgtttgtttggtaggaagttgaggtctggctatattgcccaggctaatctcaaactcctgtgctaaagtaatcctccccctcagcctccagagtagctggaattacagacataagctaccatgcccagctcagaacccctttaaaatgtgtgaagtcaggagccctgtgggaactggcttcaaccctgccactgtgaatgagcccagaccaacaaccgtccactcaaaactacaggcttactgctttgttgccttagttagaaacccaagcctcttcctgacaccttttctggttttttgttttttgtttttgttttttgtttgtttgttttgagatggagtcttgctcttgtcacccagactggagtgcaatggtatgatctcggctcactgcaacctctgcccctcaggttcaagaaattctcctgcctcagcctcccgaggagctggattacaggcaccagccaccacacctggctaattttttgtatttttaatagagacagggttttgccatgttggccagtctggtcttgaactcctcactacaggtgatccacctgcctcagcctctcaaaatgctgggattgcaggaatgagccacggtgcccagccaatctttcttaacccaccttctacaccaagccctacccatcccatcatccaaatgtgtcatttccctcccacaccactaacagcaaccatcgatgtttacgccaccctcgtctccctcctgggctgttccaagagcctccttcctgacctccctgcttccagcttcaccccttgctccaaccaaaacaatcttgctaacacacaaatctacctcatcactcccctgcttaaaaccttgcaaaggcttctcattgcacccaggaggaagtccaaaagccttaactggatttataacatcttaacgatctgcccctccctttccagtccaatctgatcagactcaacatgcttgcttttagagtgccagattcgttccgtcctctgggccttgacaagtgctattccctctgcctaaaacacttttccccctcttcttcacttgctgagtttattcaacaaattcattcaagaactacctacagaatgccagggttgtatcaggcgatctccttatgaggttcggagtctcatggaagagtcatagttacctcaagggacaaatcaaataacacagattaatcaatcattacaaattgagatcagtgccatggaggggaatgacagagaggcctaaccttggcatcttggaaggcttccctgaagaaggaatctttaagctgagaggtgaagtggttgttcagtactggcaataggaaccggggactgtgtggccccattctccaccaagtggaacatgactgcccactatgggagtaaaggaggctagcaggcaagagtgagtgtgtccatggctcctggcctgaggctcctgcaactgcagttttgcctcttattttcccagtcactccatttttctctcatgggctagtcatgagcaaaccctgactaataaaatgacaaggcttccagcagatggtagcatggcctttgaaatcatagagacttggcctcgattcctggaccctccacttgtcaccgtgtggccctgggccagttacttcccctgtgtaagcatgagttacctcatctgtaaaatgggacaaaaattcctccctttgcaaggttctcctaaggaggaaatgagatggaaggtgtgtcctttcaaaaatgaactgcaaaagaattgaaagcctcgtgccatttgcagttcaagtaggggtaaatgggtgatggggtccctcatgctttgggccaaaatctaccaggctggctgggctcaaagagaccaaactagagaattcaaaatttctcactgcagaaaaaagccagcactaccatttaaactgttgatgtattcttttaaaattgactttctgtcagagacaagtataattgaatccccggacccttcgatattaaagaggtttctggactcatttcccccacccctagcccaccaacaataaaagaaaaacagagttgtattaaaaatatttaatattcggcacttgatcctacctccaaacagaaacacctaactatgggccagagagtggagaaagagcagatggctgataaggtctcgcatggtctggccccttcccatagggcccaatagatgacacccctttcttaccctgccttaatatagaacttatgaagtcctgcagatggagatcaagacatcagctgcgttgttgaaagtatattgttgtggactgtggcttaagtgtcaacactgggtttcctaagtccacctcatcatcaagcatcctcacacgtccagcctcaaggaacggtaggactgtagacttcaccctgcaggggcagaatgtttactgccaagagacccctaacggagtccagaatacccagcacctcgtctcaaactcactagtcagaataatcacttgtcttccctgggaggagagagggaaggagcagagagagagaggccaggaaagaccagaaaaagaaaataagccgttatccctaacttcattcactctatctgtgccctgtccaaactggtcttcttttcagctctgcaaaaatgccatgcttctttgcagccagggcctatgtacatgctttactttttttttttttttttttttgtatatttggaacactctcttctattctcgttttgtctggtgacccttattcatcttacaagtttctgcttaaacattatttccctaggaaagccttcctgatctcccacacaaggtcatgtccccctgttaaatgctctcctagcttctgtattccctctatgtcacatttgtcgcatttgtcatgattttaagtacataattatttgtgtgattatctgtccaatgtcggcttgctcaagaagactcgagggcagagctgtgcttgtgaggatgaccactgtatgtatcctggcatcagtctcactaccaccacacagtagaggctcaagatattaattaaaggaagtaagtaacagtaacacacaaagccattttaagcactttgcatacattaatctttttaatgtttaaagtacttctgttttacaagtggggaaaccaaggcacaaagaggttagataattagctcaaggtcatacagctaacgagcagagctgggatttgaacacaggcagtcagactccagcagcagtgctactcacaactgcactgaagtgcatcttgaggaggagagatgggagaagtgtgtgccatgcacgagagattggggagggtcctgatgcacagacgggcttttcttgcacaagagtctagccagaggaaaacaaagatgggagaaaagacagaaaagaacgttccatctgccacattgaggtaagaagtcagggatgcctaaggggatgtccggggtgaaatgcaggggcagagaaagccccaaagctcactgctgcctctggaacattaagttaagccatcaactcccgccctggtcctgggagtcggtatatgagtttggccagttgccatgacaattggctctcttggcccttcagggtggtccagctatggggacccctgcctccctggggttctcagcacacctgacagataatttccacctcatgtcatgatctacatgaaacacatcacagtgcctgatagagtaaaagtgtgatacatgtttttaaaacctctcagaagagcctgcatgggagtcacagccctgaccatgggtgcctctccctggaggcaatgtcccttggggggctaattgttcattaactccaccagtgaagtcctacagagatggaatgctgccaccccacgtgcccacacctgcgtagtcagcatctggcaggctcattgttttaagtgatgagcaattgtcattttctgtcgcctccatgataaatcactttaagaactcctttctctcgacagcataagtaattacagccctggtatctggggccctggcaccgattagaagggaagcaaactacaccggaactgatgctgactcatttttctttctcaaaagggcctagaggccacaggttcagaaccatttggctggacccttcccgggctgaaagctgactccctccaccccacagcactgccagagctgaagcctggagacagagccctccactcccaccctgcaaagcccctcacctccttttctctagctgtctttaagacatgattcccaagtgaaccaatgattaggaggaaaatgtattgtgctataacagagagaaataattaggttagataataagaaagggaagtgtaccttgtaagaggttctgctgtggttatgcattcttgggaatatttgatctattatgtttttttcttggtagacatgggatgtattgaatcagtagaataaataaacctcttggtaagcaagaaaaaacatacctcagatggtaagaatcttggtgacccagaaatgacaatgaggaaaagatcggatgatcctgacattctcataacctgagaaggagatcctggaacagtacttgggagagcattgcacttaggattaaagaattaaagcacacgggggcagacttgagtggtagaaaggatatatgaaacccatgtgctcaagaatgtcctgggtacggtacctgctgtcacttctaccaccaatggttgccaccatcataagcagttgtcagtgaattcacatcatgcacctgtctgcctatctgctggtgtcaccacatgagagaaacctctggccaagagttaaggaaggccattctcctggcagcttctgtgaaccagcctgggtgccagctagcctgacagcctcctgtcttgattactctccctgcccctttaccaatagcctgagagtcatgcgcttttgcagaagttattggctagggagtcagcaaacaatcctgggcaatgacaccaaaaataaaaggatggaagatgttcatgattaaataaattttggaaatgctgcatactttagccttctctgggagattcacagtgcacattagcattctaaatgctctgagaagccctgcaagaaataaccaggctagctttatttaacccattgtttcctgcactgctctgatcaaggtacc

SEQ ID NO: 209 - DNA, 9661 bp, Homo sapiens
taaacctttgtcacaacattcccagtgatcgttttccatcttggggatgaggattgaattctcaggtcggggaaaacagaaaatagagattagggtgggaaagcacaggcgagaaagctctggggaacagacaggatattgaagctgaaacagagcacatttcagaagggggctggagattagggataggattatggcaaggacaataataataacgtatagctcacttattctgtgccctactaagtgttttgcatgtcatctttctctgtcatgggttaaaatgtatgtcaccatttcccaaaattcccagcacccaggctgggaattgactggggatctgactgtgaccttacctggagatagatatgtctttacagagataatcaagttaaaatgaggtatttagggtgggccctaatccaagatgattagggtccttagaaaaaggggaaatttggagacagacgtgcatatcaagggaatgccacatggcatgaacatagccatctacagacaaaagagaggggcccagaacacatcctccctcacagccctccaaggacacccccctgccaacaccttgatctcaaacttccagcctccagaactgtgagacactaaaatcctgtttttttaaaagcatagtttataatactttgttacagcagtcctagcaaacaaatacaagttcatcaagccacggctaccattctagaaggccaactctgttgttatctccattttacagaaactcaggtttgcagaggctgagtaactcgcctacatcacacagctaggaagaagaggagttggcatttcaaacaaggtttgcctgattaccaagagatcttaaccactaattttaaccatgctgcatggggtgctgggggttggggagaggttgaatggggcacagcacctctcattacatctggtaacttaaagcacaggccctgactttgcccacctctcaaaggacctccccctctcccacacatacatccctttgctctgcccagggttggtcctggggagtggggagcttggcgactgaggactgggtggactgtagggtggacactatccccctaggaggaatctcatttcccctccagcactaaggaaacaatgcggctgtcagcccgtcccgggaaaagcctgctggtcccaatggtgcccccgccccccagcaggcactgtggttggcctgactcttctcattaggcctggggtgacaggacgtatcgcagccagcagcttgctgcagcatctcctgcctcgagcaccagagctctgctggggagacgcagtggctgccaaccctgactcaccttgtctgctcctggagcctcaccctccctggctaattatccccaaaacctgcactgtccagaggccttcggcacagagacatccacactcttggccttttgtgggcaggaaaggcctgctgaggctgttttaagaaagcagaattgtcagagcccaagaggtaattagtatttaagaggcacaagttggcaaggttaaaagctgagaaataaacacacacacacacacacacacacacatacactccatttcaaataattcttaaaagagtaaacaggaagatatggcccctgcctgggaaaccattaagaaagaaagatagaattccacaccacagatgacctcaggcactgctgtctggacagaggctcttccgcagtgccaggacagggctacttctaggctgtgaagctctcatctgcccccaaaacctcctcttcctccactcctccttgtctctgccatcatccttcctgccacaccactgaaaacctcagaatctcccactgctctgtccactccaacccaatgtgctggggatttgtcctttgccatgtaactcttatccagccctgcctctccagcccacagtccctgccctagttccagcctggaccactataacacctcctttctggtcaccccacattggatccatcttccaaacaaaggtttgattgtgtcatctttctacttaaaactctttcctggcacctcaccgccaagatgccccgtgggagagtgcattttcccttgacctctggcactggagtggaactgcagctccaccttgcttccatatggccctgggtaaattactaaatctctccaaactcagcttcctcatctgtaaaatgggtgtaaccatacttacctcaaggaactgttgtgagtggtgagcaatcagcaccttgaacctgttcatgactcagtaaagtgtggcttttatgattattaatccaagaaggagaacgggattgtccatggttacctggtaggttagtagcaagtccaagacctcgaaccctcagggcactgcagagcaaaatatagcaggccctcgataagtatctgttgggtgagtggctgtcaatcaatccataaatcaatcacttgatcccagccggccctaggtaataagttccacgagcctattaacctcctctcaagacaaaggtaaggaaacccagcttccttttgtggcccgtgcttatttctcaagactcaaggaagctccctggtgtttacatctgggattgtatgaacaagccttaactggctcttttcagacgtcctaatcctgatgtggactcagctttgcttttcagactgcgaaggcactggccctctggtttcccacatgagagtgtctttctctgagtggcagcccagaaaaggcttcctgagttcctgcagctgacccagctgggatttcaggtggcccagacagttggaccagaatttctatctgtagtaggataaattctacctgttgagggtgactctgaaattttttgtttgtttgtttgtttgtttggtaggaagttgaggtctggctatattgcccaggctaatctcaaactcctgtgctaaagtaatcctccccctcagcctccagagtagctggaattacagacataagctaccatgcccagctcagaacccctttaaaatgtgtgaagtcaggagccctgtgggaactggcttcaaccctgccactgtgaatgagcccagaccaacaaccgtccactcaaaactacaggcttactgctttgttgccttagttagaaacccaagcctcttcctgacaccttttctggttttttgttttttgtttttgttttttgtttgtttgttttgagatggagtcttgctcttgtcacccagactggagtgcaatggtatgatctcggctcactgcaacctctgcccctcaggttcaagaaattctcctgcctcagcctcccgaggagctggattacaggcaccagccaccacacctggctaattttttgtatttttaatagagacagggttttgccatgttggccagtctggtcttgaactcctcactacaggtgatccacctgcctcagcctctcaaaatgctgggattgcaggaatgagccacggtgcccagccaatctttcttaacccaccttctacaccaagccctacccatcccatcatccaaatgtgtcatttccctcccacaccactaacagcaaccatcgatgtttacgccaccctcgtctccctcctgggctgttccaagagcctccttcctgacctccctgcttccagcttcaccccttgctccaaccaaaacaatcttgctaacacacaaatctacctcatcactcccctgcttaaaaccttgcaaaggcttctcattgcacccaggaggaagtccaaaagccttaactggatttataacatcttaacgatctgcccctccctttccagtccaatctgatcagactcaacatgcttgcttttagagtgccagattcgttccgtcctctgggccttgacaagtgctattccctctgcctaaaacacttttccccctcttcttcacttgctgagtttattcaacaaattcattcaagaactacctacagaatgccagggttgtatcaggcgatctccttatgaggttcggagtctcatggaagagtcatagttacctcaagggacaaatcaaataacacagattaatcaatcattacaaattgagatcagtgccatggaggggaatgacagagaggcctaaccttggcatcttggaaggcttccctgaagaaggaatctttaagctgagaggtgaagtggttgttcagtactggcaataggaaccggggactgtgtggccccattctccaccaagtggaacatgactgcccactatgggagtaaaggaggctagcaggcaagagtgagtgtgtccatggctcctggcctgaggctcctgcaactgcagttttgcctcttattttcccagtcactccatttttctctcatgggctagtcatgagcaaaccctgactaataaaatgacaaggcttccagcagatggtagcatggcctttgaaatcatagagacttggcctcgattcctggaccctccacttgtcaccgtgtggccctgggccagttacttcccctgtgtaagcatgagttacctcatctgtaaaatgggacaaaaattcctccctttgcaaggttctcctaaggaggaaatgagatggaaggtgtgtcctttcaaaaatgaactgcaaaagaattgaaagcctcgtgccatttgcagttcaagtaggggtaaatgggtgatggggtccctcatgctttgggccaaaatctaccaggctggctgggctcaaagagaccaaactagagaattcaaaatttctcactgcagaaaaaagccagcactaccatttaaactgttgatgtattcttttaaaattgactttctgtcagagacaagtataattgaatccccggacccttcgatattaaagaggtttctggactcatttcccccacccctagcccaccaacaataaaagaaaaacagagttgtattaaaaatatttaatattcggcacttgatcctacctccaaacagaaacacctaactatgggccagagagtggagaaagagcagatggctgataaggtctcgcatggtctggccccttcccatagggcccaatagatgacacccctttcttaccctgccttaatatagaacttatgaagtcctgcagatggagatcaagacatcagctgcgttgttgaaagtatattgttgtggactgtggcttaagtgtcaacactgggtttcctaagtccacctcatcatcaagcatcctcacacgtccagcctcaaggaacggtaggactgtagacttcaccctgcaggggcagaatgtttactgccaagagacccctaacggagtccagaatacccagcacctcgtctcaaactcactagtcagaataatcacttgtcttccctgggaggagagagggaaggagcagagagagagaggccaggaaagaccagaaaaagaaaataagccgttatccctaacttcattcactctatctgtgccctgtccaaactggtcttcttttcagctctgcaaaaatgccatgcttctttgcagccagggcctatgtacatgctttactttttttttttttttttttttgtatatttggaacactctcttctattctcgttttgtctggtgacccttattcatcttacaagtttctgcttaaacattatttccctaggaaagccttcctgatctcccacacaaggtcatgtccccctgttaaatgctctcctagcttctgtattccctctatgtcacatttgtcgcatttgtcatgattttaagtacataattatttgtgtgattatctgtccaatgtcggcttgctcaagaagactcgagggcagagctgtgcttgtgaggatgaccactgtatgtatcctggcatcagtctcactaccaccacacagtagaggctcaagatattaattaaaggaagtaagtaacagtaacacacaaagccattttaagcactttgcatacattaatctttttaatgtttaaagtacttctgttttacaagtggggaaaccaaggcacaaagaggttagataattagctcaaggtcatacagctaacgagcagagctgggatttgaacacaggcagtcagactccagcagcagtgctactcacaactgcactgaagtgcatcttgaggaggagagatgggagaagtgtgtgccatgcacgagagattggggagggtcctgatgcacagacgggcttttcttgcacaagagtctagccagaggaaaacaaagatgggagaaaagacagaaaagaacgttccatctgccacattgaggtaagaagtcagggatgcctaaggggatgtccggggtgaaatgcaggggcagagaaagccccaaagctcactgctgcctctggaacattaagttaagccatcaactcccgccctggtcctgggagtcggtatatgagtttggccagttgccatgacaattggctctcttggcccttcagggtggtccagctatggggacccctgcctccctggggttctcagcacacctgacagataatttccacctcatgtcatgatctacatgaaacacatcacagtgcctgatagagtaaaagtgtgatacatgtttttaaaacctctcagaagagcctgcatgggagtcacagccctgaccatgggtgcctctccctggaggcaatgtcccttggggggctaattgttcattaactccaccagtgaagtcctacagagatggaatgctgccaccccacgtgcccacacctgcgtagtcagcatctggcaggctcattgttttaagtgatgagcaattgtcattttctgtcgcctccatgataaatcactttaagaactcctttctctcgacagcataagtaattacagccctggtatctggggccctggcaccgattagaagggaagcaaactacaccggaactgatgctgactcatttttctttctcaaaagggcctagaggccacaggttcagaaccatttggctggacccttcccgggctgaaagctgactccctccaccccacagcactgccagagctgaagcctggagacagagccctccactcccaccctgcaaagcccctcacctccttttctctagctgtctttaagacatgattcccaagtgaaccaatgattaggaggaaaatgtattgtgctataacagagagaaataattaggttagataataagaaagggaagtgtaccttgtaagaggttctgctgtggttatgcattcttgggaatatttgatctattatgtttttttcttggtagacatgggatgtattgaatcagtagaataaataaacctcttggtaagcaagaaaaaacatacctcagatggtaagaatcttggtgacccagaaatgacaatgaggaaaagatcggatgatcctgacattctcataacctgagaaggagatcctggaacagtacttgggagagcattgcacttaggattaaagaattaaagcacacgggggcagacttgagtggtagaaaggatatatgaaacccatgtgctcaagaatgtcctgggtacggtacctgctgtcacttctaccaccaatggttgccaccatcataagcagttgtcagtgaattcacatcatgcacctgtctgcctatctgctggtgtcaccacatgagagaaacctctggccaagagttaaggaaggccattctcctggcagcttctgtgaaccagcctgggtgccagctagcctgacagcctcctgtcttgattactctccctgcccctttaccaatagcctgagagtcatgcgcttttgcagaagttattggctagggagtcagcaaacaatcctgggcaatgacaccaaaaataaaaggatggaagatgttcatgattaaataaattttggaaatgctgcatactttagccttctctgggagattcacagtgcacattagcattctaaatgctctgagaagccctgcaagaaataaccaggctagctttatttaacccattgtttcctgcactgctctgatcaaggtacctttttcgtggatacctacaaacatccccaagaacattctttaaggaaatgtttgttggcacagccaagactttcagctgcaagtaagagaagagactggagtctgactcaacccaggaccacagtgacctgaccagaaaaaaagatgctgaaaccagctgtgttcacctgaggagatgaccgtgtctgagaataacagtagctcatatttgctgggtattcaccttgtacagtacttcatgatctccagttttcagatacggaaacttaaaggaatgaaatgcaatgtacccagtaatatataataggtggtcaagccaaggtctctcggtggcctgcctgacttgggtatatcccataaaccctctaggttctaactttttatttataacatgaggcttatcatattatattttacccacccttatgaagttgtgatgaggattagatgagatgataaaggacttaatgcagggcttagaacatagtaagctcttaagaagtgtcagcacaacaaatcccacacaagctgtacttaacttctccagtgatgggcagctcattgccttacaaagaccctgacatgacccgctctagttacgagaacagtcaccctgttattgagccaaaacttgtctcctcttccccttgggtcctagctgtgccctggaagcagcccctaaccctcctcccctgacatctctgcagagacccagacaaggatgtcatccccaagtctgctggtcttttctccttatcctccttccccagttcattgagcttgggagcaggcactttgccaccaagttaagacctccaatcatttcttcttcctttaccccatccctgggcagggcccctggtgtttctacgctcctcccttgaacagcacacttctaaagggtttctctctatctgcaaaagccagcatctgccacagagcacccagaccgtgaaagttgatggagggcacggacatcctgcatgccagccagcccaacttgcctgggtggccaagaaggggacaggtcagcctcacacctaactcagctccctggggaaaccaagtgaggagaagggatgtgctggcccagatgtcactggatgcaagaccaggtgcacaacccagcagcctcttgaaggcgggaagtccccagaggacacagaacacagaggaagagagcaacgttgttatggtttaacccttagatggcacataccatttaccagcacagttctatgtactttacctgcagattaactcatttatcctcacaagaccctatctgctcccatttgagagaggagcaaaccaggccaaagagaggttaagttattttcccaagatcacacagcaaatatgcaatacagctggtgtttgaggccagacaatctggctccagagcttgcatcctgactctctgtcctacgttgtctcccagcactataccatctagagcaatccagggaagaaaaggctacaggaaggaatggtaaaactgagactaaaagggtaggaaggattcagagacttaaaaacagagagaaagggcattgtctgggagaacagcatggagcaaatggtaaaggtgtaccataggcagggaggaggtcggctggctggggcagaggccttggggaaggt

SEQ ID NO: 210 - DNA, 2108 bp, Homo sapiens
ctcctggctttatcattgcaccatacataccatgtgcaggaaaacaagtgtttccttcctgctcctgacatgggcggactccagggttctggatggagagacccagaatccagacttccctacagcagctcccagccttctcacagccccaggggcagctggacaggtacccagggcagccacacaacagaacaagaggcctcgtggggcctgttagtctctgcatttgacacagcgaggggtggcatagtggtccctgccctcttttccttctgctcacacccgaaggaggaacaggtgcatcggaactgcaggaggaagagagtttggaaaagtccctggcgtgactgtcatagataattcccaccttatccttgccctcgagaaccacacatgtagtagatgacatagaggcatttaacaatttcatataatttaattgttttattaaacaattgtgtttatcaattggctcagaaaatccctcgaaaataggacaagctgttctcatgagtgtgtacaagttgtctctagcacaccgctgactcaaacccaggacctctgacaccaaatgtaacccccactctacacagccaaaggtactggagctccacaggcagtaagcagtggggctgagatttaaagctagtctgaccccaaagccaagtgttaatcattatcatttggataatgatctccattggagggcctgatgggagaagaggagaaacaaggacgctgacccagaatgcctgtgggctttacttccctgatcccaggccactggggcagattgaggggggatggtcggggggtgtcattaaacctcaggcatagtcaagcattgttccctcactgcagaggggcagacctgcccagggtcacacacaaagcatggggctatgctcaggctagagcctggatctcctcagtcaccctcagacctaggcataccctcagccctggtgacctgtgcccagtggggaccaactaacaaaaaccaccactgcagacaggtgtgagctgtgaggaagtcccgcaagacagaaagcctgaagcctgctgagcccagcctgggccagaccctcttgggggtgctgcagttttagagaggagggcaccaacgaatcaaacaagagccctgttcacaggccgcactgtctaacacaggtgctactagccgcatttgataatttatatttaaattcattaaaattaagtacaatgtaaaattcagttccttagtcataatagccacatttcaagcgctcaatagccacctttggttaaaggctattgtgtcagatagtgcagataaagaacattttcatcaatgcagaaaaatctgccggacagcactggccctagaggaaagtcagataaaatgaaaaacaacaatttcgcccgccggaatggagccagctgccgagaagtgtttcttggaggaggaaggtcttgaggttccaactcacaggagccctgcccactcccaggtctgggccctccctcttctcccctccaaccccagccccaggcctgagcacgctctgatttctttccggctgcttgtgtgtggctgtcctccaccacccggggtggagaatggggcctgtggggacctgcagagagttgcccaggagccagcagaagtgggagcagctgaaccttctcaggctgccagggccgtggcccacttacccgcatccctaagcctcagaaaaggagggctctggggagctgctggggcttggaaagtcacagtgatggtgcaggcaggggcgggcgctgtgtgtttgtctctcggcatctttgatgtgcctcggagtctttcatgtcggaggctgtcctctgccaagggccccatgtgctgtttgcccttttccttttattcctttttttattcatttcattaaattggttctgtagagggcaaaagaagagcccagcagacaagaaatgctctcaggttataggggaagagaagtgggggcgagagctcacttctggctgggcgggtgcaactgaaagcaaagcactggctcatccacccacacttcaaggcttcagctgctcacacactaagtaagacctcttagaatctttataga

SEQ ID NO: 211 - DNA, 11488 bp, Homo sapiens
aaataattaaataagtagagtttgatcagtagtgggagtggagagtggacctcagagagccctgagcagccccacttctgccgctggtctagttaccatcactcccggggaggagccacagctgctgcagcaggacccagtcaccatcaccgcacccatcagcagggcagagacccagcacccacctgccacccctcccccaccattctcgcacccccgcccctgccactcagcttcaccgacaccaagcccagcaatatggggagcggtgcaaggactggtgagatttttaagaatttcatttttaatttgtactaaaagcttacaaattggtgatttttttcaaaaaagtcagcaaactgcaagcacctgttaataaaggtcttaataaattatcaaataaataaataaaatggaaaaaagaaaggaacattcttcagtgaagtagacagcataaacaaaaagaaatcacaacttctggaaatcaaagacacagagaaatgcaaactgcacttgaaagtctcagcaagagaatcaaataagtagaagaaagaacttcagagctcaaagacaagccttttgaattaacccaatccaacaaaaacaaggaaaaatgaattaaaaaaaatgaacaaggccttcaagaagtttgggactacgttaaacatccaaacctaagaataattggtttattcagaagagaaatataaaagtttggaaaacatctttgagggtataattgaggaaaactttcccagccttgatagagatctagacatccaaatacaagaagctcaaagaacacctgggaaattcattgcaaaaagatcatcacctaggcacatagtcatcaggttatctaaagtcaagacaaaggaagaatcttaagagctatgaggcaaaagcatcaggtaacctataaaggaaaacctatcagattaacagcagatttctcagcagaaactctatgagctagaagggacctgggtcctatctttagcctccttgagcaaaacaataattagccaaaaattttgtatccagtgaaactaaacttcataaatgaaggaaagatacagtcttttcccagtaaacaaatgctgagagaatttcccactacctagccctcactacaagaactgccaaaaggagcatgaaatcttaaaacaaatcctcaaaatagaacctctttaaagtgtaaatctcacaagagttatataacaataacacagtagaaaaaaaacccaagttattcagacaacaaacagcacaatgaatagaatagtaccacacatctcaatactagcattgaatgtaaatgccctaaatgttccacttaagatacagaatggcagaatggataagaattcagcaaacaagtttctgctgtcttaaggagactcacctaacacataaggactcacataaactttaggtaaagtggtggaaaaaagatattccacacaaatgaacaccaaaagtgagcaggagtagctattcttatatcagacaaaacaaactttaaagcaaaagcagtttaaaaagacaaagagggacattatataatgatataagaaatagtccaacaggaaaatatcacaattctaaatatatatgcacctaacactggagctcccaaatttataaagcaattactactagacctaggaaatgagatatatggcaacacaataatagtggaggactttaatactccaccgtcagcactagacaggtcatcaagacagaaactcaacaaatgaacaatggacttaaactatagcctacaacaaatggacttaacagaaatttacagaacattctacccaacaattgcagaatatacatgctattcaccagcacatggaacattctacattctccaagataaaccatatgatagaccacaaagcaagtcacagtaaatttaagaaaactaaaattatattaagtattctctgagaccacagtcgaatacaattggaaatcaactccagaagaaaccctcagaatcatgcaaatacatggaaattaaataacctgctcctgaatgattcttgggtccacaataaaatccagatgaaaatttaaaaaaatttgaactgaatgataatactgacacaacctatcaaaacctctagaatacagcaaaggtgatgctaaaaggaaagttcatagcattaaatgcctacatcaaaaagtctgaaagagcacaaatagacaatctaaggtcacacatcacagaactagagaaacaagaacaatacaaacccaaacccaacagtagaaaagaaataacaaagattggagcagagctacgaaattgaaacaaacaacaacaacaaaaaagataaatgaaacaaaatctcgttctttgaaaggataaataaaattgatagattattagtgagattaaccaagaaaagaatagagaagattcaaataaactgaattaaaaatgaaatgggagatattacaactgatacacagaaatacaaaagattattcagggctactgtgagtgcctttaaacacataaactggaaaacctagagaagatgaataaattcctggaaatatacaaccctcctagattaaaccaggaagatatacaatctctgaatataccaataaaaagcagtgagattgaaatgataatttaaaaattgacaaaaactgtatgtgaccagatggattcacagctgaattgtatcagacttcacagaaggattggtaccaatgctatgacactattccaaaagatagagaaagagggaatcctacctaaatcgttttatgaagccagtatcaccctaatacctaaaccagtgaaggatgtaacaaaaaaagaaaacttcagaccaatatcactgatcaatgcaaaatcaatgcaaaaatcctcaaaaaattatgacaaatccaacagcatatcaaaaagataatccactgtgatcaagtgggtttcataccagggatgcaggaatggattaacatctgcaagtcaacaaatgtgatacactacataaatagaattaaaaacaaaaatcacatgatcatctcaatagtcacagaaaagcgtttgacaaaatccagcatccacttatgattaaaaccctcagcaaaattggccatagcaaaataggacatataataaggtaataaaagccatctatgacaaacccacagccaacattatactgaacggggaaaagttgaaagcattcccctaagaactgaaacataataaggatgcccattttaaccacttctattcaacatagtactggcagtcctagccagagcaatcagacaagagaaagaaataaagggcatccaaattggtaaagaggaagtgaaactttgctgtttgctgatgatatgattgtatacctagaaaatcctaaagacttgtacaaaaagctcctacaaagggtaaataaattcagcaaatttcaggatacaaaattaatgtacgcgaatcagtagctcttctacacaccaacagcaaccaagctaggaatcaaatcaagaactcaacccctttcacaatagctgcaaaaaagtaaaaatacataggaatatatctaaacaaggacgtgaaagaacaacaacaaaacactgctgaaagaaaacatagatgacacacacaaattgaaacacatcccatgctcatgatgaggagagtcaatattgtgaaaatgaccatactgccaaaagcaatctatagattgaatgtaatttccatcaaaataccaccatcgttctccacagaactagaaaaaacaaccctaaaattcatatggaaccaaaaaagagcccacataaccaaagcaggactaagcaaaaagaacaaatctggagggatcacattacctgacttcaaactatactataaggccatagtcatcaaaacagcatggtacttgtatgaaaaagggacagagactaatggaacaaaatagataacccagaaataaagccaaatacttacagccaattgctcttcaacaaagcaaacaaaagcatgtagtggggaaaggacactccattcaacaaatcgtgctgagataattggcaagccacatgcagaagaatgaaactggatcctcacctttcaccttatacaaaaatcaactcaagatagatcaaagacttaaatccaagatctgaaaccagaaagattctagaagataacatcggaaaaacccttgtagacattgacttagacaaagacttcatgaccgggaactcaaaagcaaatacaacaaaaacaaagataaacagatgggacttaattgactaaaaaccttctgcacagcaaaagaaataatcagcaaagtaaaccgacaacccacagagtgggagaaaatcttcacaatctatatatccaacaaagactaatatccagaatctacaaaaaactcaaatcatcaagaaaagaaacaatcccatctaagagtgggctaaggacatgaacagacaattctctaaaaaagatatacaaatggccgacaagcatatggaaaaatgctcaatatcactaatcatcagagaaatgcaaatcaaaaccacaactcaataccacctgcctcctgcaagagtggtcataatgaaaaaaatcaaaaaaataatagatgttgttgtggatgtagtgaaaggggaacacttttatactgtcggtgggaatgcaaactagtacaaccactagggcaaacagtgtggagattccttaaagaactagaagtagatctgctgttcgatccagtaattccacttctaggtatctacacagaggaaaaaagttattatatgaaaaagatacttgcacatgtttatagcagcactatttgcatatttgcaattgcaaaaaaatattagatcagcccaaatgcccatcaatcaacgagtagataaagaaaatgtggtactgtggtatacatatatcccaggggataacactcagccataaaaaggagcaaaataatgacattcacagcaacctggatggaattggagactattttttaagtaaagtaactcagcaataaaaaaccaagcatcatatgttctcactcatatgtgggagctaagctatgaggctgcaaagggataagactaatacatcagattttgaggactcaggggaaagggtggtgggtggtgagggataaaagactacacactgggtacagtgtacactgcttgggtgatgggtgcaccaaaatctcagaaatcactgctaaggaacttattcaggtaaccaaacaccacctgttccccaaaaacctattaaaaaaattttttttagaacaaagaaaaaccaacaacatatttggatatttatatttcaggtgggtttcttatagacagcatatagttgagtcttggtttttaatcttaacagtctcctattttcagttgaaatttttaggccatttctatgtaatgtgaatattgatacggttgctgtttgctttctatttgtcccattcttttctttgttcctggtttcctctttttgactgctcttgaattaattttgtttaatgattccaatttatctcaattttagcttataaacgataaccttttcagtattatttagtgattgcttaggatttatagtacacgtacatatttttcttatttttatttatacataacagatgcacatgttttcagggtacatgtgataatttgatacattcatataatgtataaagatcaaattagggtgtttgggatatacataaccttaaatgtatatatgtacatatacatacacacatataaccttaaatttaaatgtatatagagagacagaaccttaaatatatatatatttgttaaatatatttgtataaataaataatttgttatatatatttatatataaatatgtatttgttatatatatatttaaggttgtgtgtgtatacatatatatgtttaaggctgtatggccatatatgtgtgtgtgtgtatctatatatatatatatttgaggttatgtatattccaattaccctaatttcatctttataatctttaaatatattttataatctttaaaatgtatattaatttgtaaatctaattataaatctttataatttgatctttaacatatacatatattttaatgctaggaacacttgaatcattcttttctagataatttgaatgtacaatagattaatgttaactatagtcaccttagtgaactatcgaacattaggtcttagatcttttatctaactgtatatttgtctttttaatcaaccctcctccacctccccttctcagcctctggtaaccaccaatcttctctctctcttcatgaggagatctatcactttagctcacacatatatgtaagaacaggcaatatttgtctttctgtgcttgacttatttcacctagcgtaacaactcccagtttcatccatgttacttcaaatgacaggattttattctcttttatagttgaataatattccattgtgtaaatattgcagatttgctttatccattcatccattgatggacacttaagttgattccctttttttggctgttgtgaatggtgcttcaaaatacgtgactacaggtatctctttgatagattgatttcctttcttttaaatatatacctactagtggaattgctagatcatacggtaattctatttttaagtttctgaagaaactccctgctgttttccataatggctgtactaataatttacattcccaccaacagtgtaccaggtttccccttcctcaacatctttgtcagcatctgttacttccagtctttttcataaaagcattctaactggggtgagataatacatcactgtggttttgatttgcattttttatgatcagtgatgttgagcttttttttatatatacctcttggtcatttgtatgtcttctttgagaaatgttttagattttttgcccatttttaataagatattttgtggggtctttttgggtgtttgtttgtttgctattgagttttctgagctccttgtgtgttctggttattcatcccttgtcaggtggttactctgtaaatatcttctcctattctgtgggttggttcttcactttgttgattttttcctttggtgtatagaagctttttagcttgatgtgatcccatttgtttatttttgcttttgttgcctgtgcttttgagattttacacaaaatatctttgtccagaaaaatatactagaacatttccctaacgttttcttttagtagtttcatagtttcaggtttagatttaaaacttagatatgatttttaatacattttgattttttatgtggtgagagatagggatctaattccatttttctgcttatggttattcagcttttgaagcaccattttttgaagagactgtcttttccttattgtatgttctaggtaccattgagttgggtataaatgtatggatttatatccagtttccttattctgttccattggtctatgtatctgtttttatgccagtaccatacagattaactatagctgtcttgtatattttaaagttaggtagtatgatgcctgcagctttgttctttttgttcaggattgctttgactattctgggtcttttgcggttccatataattgttttttctattccttttctttgttttctttttgagacagactctcactctgtcactcaggctggagtgcagtggtgccatctcggctcattgcaacctctgcctcctgtgttcaagcaatgctcatgcctcagcctcccagtgtagctgggattacaagcatgcaccaccatgcctggctaatttttgtaattttagtagagtcagggttttatcatgttggccaggctgctctcaaactcctggccccatgcaatcttcccacctctgcctcccaaatgctgggattacaggtgtgagccactgtgctcagcctgttttttctatttctgtgaagaatatccttggtattttgatagagattacattaaatctgtaaattgctttgagtagtattgtaattttagcaatattcagtcttccaatccatgagcttggaatattttttaaatgttttatatcctcttcaatttcttttatcaatgttttaaacgtttccttgtattgatcttttactatttctttggttaaactgtttcctaggtattttatattctttgtagatattgtaaacgggattgctttcttgatttgtttttcagattgctttttgttggcgtatagaaatgctacatttgtatgctggtttttatatgttggtttttgtatcctgcgactttactgaatttgtttattgattccaatgactattttgcagagtctttatgttttccaaatataagattaagtcatctgcgcataaagccaatttgacttcttttgtcctaatttggatgccctttatctctttctcttgcctaattggtcttgccaggactttcagtattgtgttgaaaaaaagtgaaagttttgataatatgatgtatgtcatttattgacttgcatatattagacaattttgcattcttgggatgaatctcacttgacttatttcacctggcatgaatatcatggtgaattatctttttaacatgctgttgaattcagtttgctattatttcattgaggattttgcatttattttcaccagtaatattgacctgtagctttctttttttgtggtgtgtttttctggttttggtatctcagtaatcctggccttataaaataagtttagaagtattccgtcatcttcaatttgtttaaagactttgactagaattggttctgtgtttaatgttcggtagaacatcaggtcctaggctcttctttgatgagagactttttattatgacttcaatcttgttactcattattggtttattgaggtttcctattccttcatggttcaatcttggtaggttatatgtgtcaagaaatgtattcatatcttccaggttttccagtttattggtgtatagttgttcatatgtctctaacgattctttgtatttctgtagttagttgttatgtctcctttttcatttctaattttacttaattgggtctactcttttaatcttagtatagttataggtttgttgattttgtttatcttttccaaaaaccaacttttcgttttatcgacctgttttactttttgtctcaatttcactatttttctgctccaatttttattacttctttccatgtactaatttaggttttggtttattattgctttgtcagttccttaagagccatcattagcttgtttatctgaagtcttcacacctctttgataaagtcatttatggccataaacttctatcatttgttgtatcccatagatttttgtatgttgcatctccatttccatgtggttcaagaatttttataatatcctttttaatttctttatgacccattgatcatttaggaacatactgttgactttttatgtgtttctgcagtttctgaagttcctcttgttattgatttctagtttgagtccactgtggtcagaaaagacacttgttcagatttatgctcttaaatgttttgagtcttgttttgaggcctgatacatggtctatcctggagaatgttccatgtacttatgaaaagaatgtatattctgatacagttgggtgaaatgttatgggtctagtgtgtagtttaactcagatgattatttgttgacttttttgtccactactgaaagtagggtgttgatgtcccctactcttactatactgaagcctgtctttgcttaacattagacttactaatgtttactttgtacacacggatgctcctgtgtggggtgcatagatgtctatacgagtatatcctctatctgaattgatccctttatctttatattctgactttctttgtctctttttacagcattttacttgtagtctattttatcagttgtaagtatagatatttctgctatttttggtttccactttcacagaatggcttcttctatctcttcactttcagtctgtgtgtgtgtttatagtaaggtaggtttcttctagatagtatttagttgtctttgttttctatccagttaatcactctgtgtatttttattagagaattatctccacttatattcagtgttattattgatgaataaaggcttattattgctattttgttgcttattttctggctgttttataactcatttttttcttttcttcctttttttacggtcttcctttgtggttaagtgtttttctctggtagcgtgttttaatttgttgctttttattttaaatctgttttaaatttgttgctttttgttttctcagtttacatattttatattgcctatctcttaatggttgctgtaattattactgttttcgatagattagttttttcatcttcatagtagagttacaagtggattgctcatcacaattacaatattagagtattctaggtttgtctgtgtacttaattttaccagtggatttctacctgtattttttatttctttttgcacattagcgtttttttttttctttcagtctgaagaactccctttggcttttaagacaggtctaatagtggtatattttctcagcttttgttatctaggaaaaactttatttctcactcatatttgaaaaatagctttgctggatacagtattcctagatggcatttttttctttcagtgttggttcttataggatatgtttgcttagagattatttgtaatttttgaattttttcatttttatcatcttgggattctggatattttagtattaatatgaatattatttcagttctgagatacaattaaaattatttgcaaaccagtttgatctctttgcatcttgcttttaagttttgtttagcagatcacagaagtgcttagtttcagtctaatttttccccaatatggacacaaaatgttatgaggactccactcaatgacctgtgaattatgaggcatggttctttccttaactcaggtagttttgtcgggtaaagactcaaagggatcctcttcagatctctggagtgctctgcctatgcagtctttccatttccagtactctgccctataaactcatgctgctttcactttccaggactttcaacaatgaatttcttcaactcagagatacctcaggatcctacctaatatgttgtctcttcaccatgtcctagggaatctctagccagtaagatcaggcaaacttgagcctcaactaattttttttttttttatttctcagagcagtatccttcattggctgatattcaatgtcttaagaattgatgtttgatacattttatttggtttcttactttggttttcattttgctttttattttagttgttttaggcataatggtaagcccagtctctattaatcttgtcctgaagtggat

SEQ ID NO: 212 - DNA, 253 bp, Homo sapiens
aaataattaaataagtagagtttgatcagtagtgggagtggagagtggacctcagagagccctgagcagccccacttctgccgctggtctagttaccatcactcccggggaggagccacagctgctgcagcaggacccagtcaccatcaccgcacccatcagcagggcagagacccagcacccacctgccacccctcccccaccattctcgcacccccgcccctgccactcagcttcaccgacaccaagccca

SEQ ID NO: 213 - DNA, 20420 bp, Homo sapiens
taacagtggatggtagatcttccaaaacttactagttccttttcagtttggcatctacttcttcattttgttaaaataaaacataattgaatatttttgtgtttatcttaatgatattgtaatttacgatttttacaagtatgcaactttatgattttaataaaccttacttaaatattattgtagccaattaagtaaagctaatccagacatctatgcatcaagtttgttataggtggtgacacactgtaaaaatgtgtacacatttatgtaacaatggaattaagtttttaatttattcctgctggtggataataacaggaagtcagggagatggaggcacagttgctatctatccagtcacatattgtttgcgactaagcaccattcaagagaccttctttctgcctcattaaataagttaatcatgtaaatcacagataaaatttgagaatatatggatatagtttacacataaatgatgtatttttattgctgagaataaaaacagatgtgacaatgcccaggtgtcagtcacaaaatattatcattctttagtatctaatatgaatgaatggaaaattaaaaggtcaaattgagatatatatatgtatgtgtatatatatataatctgtagaacataatcaccaatacaaatcattctccataattaaaataagtctaagtagctcaactgctgtgataagaatttaaaatgagccacatatcatatctggaaatggcattgagagactttttaaacagaagctccaaaaatccatcattttatgaacaaaatgtctattaatataggtttagtgagttcatgactcatgtcatggctaaatcctttttatttttcacagtccctcagtactccacaaaccttctactgttgccagcagtattagtagtgtggccagacagaggatgcaacacctgaaagattgatgcagaacaactaaataaatggaaaggcaaacgtaaacatgatcatttcaaagcaaataattacagtcatgtctctggaggcaaatattggcgcaaatttgtcttttcaatcagtttaacatgctttaaaaaacttctctttcgattttgtttgatccatggttatttaggcatatcttatttagtttcaaatacttggggattttccacatatatggttactcatttggaagttaatcgtattgtggtcaaagaacatacactgcataattttaaatgttttagatttgttgagacttactttgtggcttagaatatggtctatcttggtaaacgctttgggtgcccttaaaaatagtgtgtaatctgctgttgtacagtggggtgttccagaaatgtcaattaggacaagtggattatgttgtcgtttacctcttttatatccttactgattttctctctgtcctgtcagtcattgagacatgaatcttgaaatctctaactgtaattgtggaattgtctgtttctcattgcaattctatcatttttgacccatgtatttttcttaatttttaggcacataagcatttatccttctgataaattgacccttttaacccatggtaatattgtttgctctgaaatctactttgtctaatattaagatagcccacacagctttttgttgttgttgttgtttaatgctggcatagtttgtatttttttttatttctttaattttaacatatttggggatagcagattaagatggcagataggagacaggactagccttgtagctcacgcttggaggaacagagcaggatgtggaggctcacatcctcaacttttgctccaagaactactgcaagaatgtaccaggaaagctaagagaatccacacaccctttgaaagaattggatcattgctgcaggctccctgagacactgaaaacctgtgagtctgcttgctttttcaatggggaggttcctggtctggggccaattctcagccctgctcactggttgcctggaaatagactcggtgctgctgtggggtcacggtgggagtgagaccagcctttaggactgcaggctgctgggagcagggtgaggcctgtgactgctggctttcccctacttccctggcaacctggatgagtaagcagaggcagccataatcaccctcggaatataactccattggactgagaaccacaccccgtcctccacatgagctgaatgaagcaagccccgcccaaggagagactgaattcagatatgcctatccctgcccctaccctgtggtctttatctaccagccctggtagctgaagacaaaggtcataatcccttgggagctgtatggccctgtctaccacctgaggaacctgaatactgaaccaggtgtccctagggcaagtttgcatcctgcgcacaggaccacagataatgggctcttgagagcaccacctcctggctggaggccgaccaacacaaaaccagcacattaaacaaaaacacaaccaaggaccctcacagattccacttcactcccctgctgcctccaccaaagcaggcgttggtatccacagctgcaagacctgaaggtggatcacatcacagggctctttgcagacatgccccagtaccagcctggagcccagtagctccgctgggtggctagaccaagaaaagcaaaaagtatcactatagtttggctcacaggaagctccattcctaggggaagagggagaacactacatcaagggagcaccctgtgggacagaagactgaacggcagcacttgaatcttagatcttctctctgacatagagaaggaaccagaaaatcaattctggtaacatgacaaaacaaagttcttcaaaacctccaaaagatcatgccagctcaccagcaatagatccaaagcaagacaaaatttctgaattgccagaaaaagaattcaggtcaattattaaggtaatcaaagaggcaccagagaaaggcaaaatcaaacttaaatcaaaaacatgatataggatatgaaaggaaagtaattcatccaacttgccagtctttgtcttttaattgggtcatttagcctgtttacatttaaggttaatactgttaagtgtgaatttgatcctgtcgttatgatgctgcctggttattttgcccattagttgacgcagtttcttcatagtgtcgatggtctttacagttggtatgtttttacagtggctgatagtggtttttcctttccatatttagtgcttccttcaggagctcttgtaaggcaggcctggtggtgacaaaatctctcaccgtttgtttttctgtaaaggattttatttttcctttgcttatgaagcttagtttggctagatatgaaattctgggctgaaaattcttttctttaagaatgttgaatattggcccccactcttttctggcttgtagggtttctgcagagatatccactgtagtctgatgggcttccatttgtgggtaacccagcctttctctctggttgcccgtaacattttttccttcatttcaaccttggtgaatctgatggttatgtgtcttggggttactcttctcaaagagcatctttgtggcattctctgtatttcctgaatttgaatgttggcctgtcttgctaagagtcaaacacatcggtgggctgtatttaggagactcatctcatgtgcaaaacacacataggctcaaaataaagggatggaggaatatttaccaagcaaatggaaagcaaaaaaaaaaaaaaaaaaaagtacaggggttgcaattctagtctctgataaaacagactttaaaccaacaaagatcaaacaaaggctaagaagggtattacataatggatcgatgcaagcaacaagaaaagctaactatcctaaatatatatacaccccatactggagcacccaaattcatcaagaaagttcttagagacctacaaagagacttagacccccatgtaataatagtgggagactttaacagcccactatcaattttagacagatcaatgagacagaaaattaacaagcatattcaggacttgaactcagctctggaccaagcagacctagtagacatctacagaactctctaccccaaatcaacagaatatacattcttctgagcaccacatcacacctattctaaaattgaccacataattggaagtaaaacattcctcagcaaatgcagaagaatggaaatcataacaaacagtctctcacaccgcagtgcaatcaaattagaactcgagattaagaaactcactcaaaaccgcacaactacatggaaactgaacaacatgctcctgaatgactactgggtaattaacgaaattaaggcagaaataagtaagttctttgaaaccaatgagaacaaagacacaatatagcagaatctctgggacaaagctaaaacatagtttagagggaaatttacagctctaaatacccacaggagaaagcgggaaagatctaaaactgacaccctaacatgataattaaaagaactagagagacaagagcaaacaaattcaaaactagcagaagacaagaaatcactaagatcagagcagaactgaaggagattagagacacgaaaaacccttcaaaaaaccaatgaatccaggagctggtttttataaaagatcaacaaaatagaccagtagccagactaataaagaataaaagagagaagaatgaaatagacacaataaaaaatgataaagggcatatcaccactgatcccaaagaaatacaaactaccatcagataatattataaacacctctatgcaaataaactagaaaatctagaagaaatggataaattcctggacatatacaccctcccaagatgaaaacaggaagaagtcgaatccctgaatagaccaataacaagttctgaaattgaggcaataattaatagcctaccaaccaaaaaaaaaaaaaaaaagcatgggatgagacagattcacagccaaattctaccagaggtacaaagaggagctggtaccattctttctgaaactcttccaatcaatagaaaaagagggaatcggccctaactcattttatgaggccagcatcatcctgataccaaaaactagcagagaaacaacaaaaaaagaaaatttcaggccaatattcctgatgaacatcgatgcgaaaatccttaataaaatactggcaaaccaaatccagcagcacatcaaaaatcttatccaccacgatcaagttggctgcatccctgggatgcaaggctgattcaacatatgcaaatcagtaaacgtaacccattacataaacagaaccaatgacaaaaaccacatgattatttcaatagatgcagaaaaggccttcgataaaattcaacagctcttcatgctaaaaattctcaataaactaggtattgatggaacatactcaaaataataagagctctttatgacaaacccacagcctatatcatactgaatgggcaaaggctggaagcattccctttgaaaaccaacacaagacaaggatgacctctctcactactcctattcaacatagtactggaagttctggccagggcaatcaggccagaaaaagaaataaagtgtattcaaataggaagagaggaggtcaaattttctctatttgcagataacttgattgtatatttagaaaaccccatcatctcagcccaaaatctccttaggctgataagcaacttcagcagtctcaaaatacaaaatcaacatgcaaaattcacaaacaatcctatacaccaataatagacatacagagagccatatcacgagtgaactccaattcacaattgctacaaagagaataaaatacctaggaatccaacttataagggatgtgaaggacctcttcaaagaaaactacaaaccattgctcaaggaaataagagaggacaaaaacaaatggaacaacattccatgctcatggataggaagggccaatattgtgaacatggccatactgcccaaagtaatttatagattcaatgttattcccatcaagctaccattgacttatttcatagaattagaaaaaactactcaaaatttcatatggaaccaaaaaagagcccatatagccaagacaatcctaagcaaaaagaacaaggctggaagcatcacgcttcctgacttcaaactatactacaaggctaaagtaaccaaaacagcatgggattggtaccaaaacagatatatagaccaatggaacagaacagaacagaggcctcagaaataatgccacatatctacaaccatctgatctttgaccagcctgacgaaaacaagcaatggggaaaggattccctatttaataaatggtttttggaaaactggctagccatatgcagaagactgaaactggaacccttccttacacctcatacataaattaactcaagatggaataaagactaaacataagacctaaaaccatgaaaaccctagaagaaaacctaggcaataccattcaggatataggcatgggcgaagacttcatgacaaaaacaccaaaagcaatgacaacaaaagccaaaattgacaaatgggagctaactaaactaaagagcttctgtacagcaaaagaaactatcatcagagtgaacaggcaacctacagaatgggggaaaatttttgcaatatactcatctgacaaagggctaatatccagaatcttcaaggaactcaaacaaatttacaagaaaaaaaaaacaacccatcaacaagtgggcaaaggatatgaacagacatttctcaaaagaagacatttatgcagccaacagacacacgaaaaaatgcatgtatgtttattgcggcactattcacgatggcaaagacttggaaccaacccaaatgtccaacaatgatagactggattaagaaaatgtggcacatatacaccatggaatactatgcagccatagaaaatgatgagttcatgtcctttgtagggacatggatgaaattggaaattatcattctcagtaaactatcgcaaggacagaaaaccaaacaccgcatgttctcactcataggtaggaattgaacaatgagaacacatgaacacaggaaggggaacatcacactctggggactgttgtggagtggggggaggggggagggacagcattaggagatatacctaatgctaaatgatgagttaatgggtgcagcacaccagcatggcacatgtatacatacgtaactaacctgcacattgtgcacatgtaccctaaaacttcaagtataataataataaaatttaaaaaaattaaaaaaaaagaaagaaaaaaaaatgctcatcatcactggccatcagagaaatgcaaatcaaaaccaaaatgagataccatctcatcccagttagaatagcaatcattaaaaacgtgggaaacaacaggtcctggagaggatgtggagaaataggaacacttttacactgttggtgggactgtaaattggttcaaccactgtggaagaaagtgtggcaattcctcagggatctagaactagaaataccatttgacccagccattccattactggttatatacccaaaggattataaatcatgctgctataaagacacatgcatgcatatgtttattgcggcactattcacaatagcaaagacctggaaccaacgcaaacgtccaacagtgatagactagattgagaaaatgtggcatatatacaccatggaatactatgcagccataaaaaaatgatgagttcatgtccttcatagggacatggatgaagctggaaaccatcattctcagcaaactatcgcaaggacaaaaagccaaacatcgcatgttctcactcatagctggaaattgaacaatgagaacacttggacacaggtagggggacatcacacacagggcctgttgtggggtggggggagtggggagggatagcattaggagatatacctaatgtaaatgacgagttaataggtgcagcacaccaacatggcacatgtatacatatataacaaacctgcacgttgcgcacatgtacgctagaacttaaagtataataataaaaaaaaaaagagaaaaacaaccccatctaaaagtgggcaaaggatatgaacaggcacttctcaaaagaagacatttatgcggccaacaaacatgaaaaaaagctcatcatcactgttcattagagaaatgcaaatgaaaaccacaatgagataccatctcacaccagttagaatggcgatcattaaaaagttagggaacaacagatgctggagaggatgtggagaaatagtaatgcttttacactgctggtaggagtgtaaattagttcaaccaatgtggaagacagtgtggtgattcctccaggatctagaacaagaaataccatttgacccagcaatcccattactgggtatatacccaaaggattataaatcattctactataaagacatatgcacacatatgtttattgtggcattattcacaatagcagacttggaaccaacccaaatgtccatcaatgatagaatggataaagaaaatgtgacacatatacatcatggaatactatgcagctataaaaagaatgagtgaaaaaatatgtcctttgcagggacatggatgaaactggaaaccgtcattctcagcaaactaacacaggaacagaaagccaaacaccacatgttctcactcataagtaggagctgaacaacaagaacacacggacacagggagaggaacatcacacactagagcctgttgggggtgtaaggggctaggggagggatagcattaggagaaatacctaatgtagatgatggactgatgggtgcagcaaaccaccatggcaagtgtatacctatgcaacaaacctgcgcattctgcacgtgtatcccagaacttaaagtatgataaaaataattaaataagtagagtttgatcagtagtgggagtggagagtggacctcagagagccctgagcagccccacttctgccgctggtctagttaccatcactcccggggaggagccacagctgctgcagcaggacccagtcaccatcaccgcacccatcagcagggcagagacccagcacccacctgccacccctcccccaccattctcgcacccccgcccctgccactcagcttcaccgacaccaagcccagcaatatggggagcggtgcaaggactggtgagatttttaagaatttcatttttaatttgtactaaaagcttacaaattggtgatttttttcaaaaaagtcagcaaactgcaagcacctgttaataaaggtcttaataaattatcaaataaataaataaaatggaaaaaagaaaggaacattcttcagtgaagtagacagcataaacaaaaagaaatcacaacttctggaaatcaaagacacagagaaatgcaaactgcacttgaaagtctcagcaagagaatcaaataagtagaagaaagaacttcagagctcaaagacaagccttttgaattaacccaatccaacaaaaacaaggaaaaatgaattaaaaaaaatgaacaaggccttcaagaagtttgggactacgttaaacatccaaacctaagaataattggtttattcagaagagaaatataaaagtttggaaaacatctttgagggtataattgaggaaaactttcccagccttgatagagatctagacatccaaatacaagaagctcaaagaacacctgggaaattcattgcaaaaagatcatcacctaggcacatagtcatcaggttatctaaagtcaagacaaaggaagaatcttaagagctatgaggcaaaagcatcaggtaacctataaaggaaaacctatcagattaacagcagatttctcagcagaaactctatgagctagaagggacctgggtcctatctttagcctccttgagcaaaacaataattagccaaaaattttgtatccagtgaaactaaacttcataaatgaaggaaagatacagtcttttcccagtaaacaaatgctgagagaatttcccactacctagccctcactacaagaactgccaaaaggagcatgaaatcttaaaacaaatcctcaaaatagaacctctttaaagtgtaaatctcacaagagttatataacaataacacagtagaaaaaaaacccaagttattcagacaacaaacagcacaatgaatagaatagtaccacacatctcaatactagcattgaatgtaaatgccctaaatgttccacttaagatacagaatggcagaatggataagaattcagcaaacaagtttctgctgtcttaaggagactcacctaacacataaggactcacataaactttaggtaaagtggtggaaaaaagatattccacacaaatgaacaccaaaagtgagcaggagtagctattcttatatcagacaaaacaaactttaaagcaaaagcagtttaaaaagacaaagagggacattatataatgatataagaaatagtccaacaggaaaatatcacaattctaaatatatatgcacctaacactggagctcccaaatttataaagcaattactactagacctaggaaatgagatatatggcaacacaataatagtggaggactttaatactccaccgtcagcactagacaggtcatcaagacagaaactcaacaaatgaacaatggacttaaactatagcctacaacaaatggacttaacagaaatttacagaacattctacccaacaattgcagaatatacatgctattcaccagcacatggaacattctacattctccaagataaaccatatgatagaccacaaagcaagtcacagtaaatttaagaaaactaaaattatattaagtattctctgagaccacagtcgaatacaattggaaatcaactccagaagaaaccctcagaatcatgcaaatacatggaaattaaataacctgctcctgaatgattcttgggtccacaataaaatccagatgaaaatttaaaaaaatttgaactgaatgataatactgacacaacctatcaaaacctctagaatacagcaaaggtgatgctaaaaggaaagttcatagcattaaatgcctacatcaaaaagtctgaaagagcacaaatagacaatctaaggtcacacatcacagaactagagaaacaagaacaatacaaacccaaacccaacagtagaaaagaaataacaaagattggagcagagctacgaaattgaaacaaacaacaacaacaaaaaagataaatgaaacaaaatctcgttctttgaaaggataaataaaattgatagattattagtgagattaaccaagaaaagaatagagaagattcaaataaactgaattaaaaatgaaatgggagatattacaactgatacacagaaatacaaaagattattcagggctactgtgagtgcctttaaacacataaactggaaaacctagagaagatgaataaattcctggaaatatacaaccctcctagattaaaccaggaagatatacaatctctgaatataccaataaaaagcagtgagattgaaatgataatttaaaaattgacaaaaactgtatgtgaccagatggattcacagctgaattgtatcagacttcacagaaggattggtaccaatgctatgacactattccaaaagatagagaaagagggaatcctacctaaatcgttttatgaagccagtatcaccctaatacctaaaccagtgaaggatgtaacaaaaaaagaaaacttcagaccaatatcactgatcaatgcaaaatcaatgcaaaaatcctcaaaaaattatgacaaatccaacagcatatcaaaaagataatccactgtgatcaagtgggtttcataccagggatgcaggaatggattaacatctgcaagtcaacaaatgtgatacactacataaatagaattaaaaacaaaaatcacatgatcatctcaatagtcacagaaaagcgtttgacaaaatccagcatccacttatgattaaaaccctcagcaaaattggccatagcaaaataggacatataataaggtaataaaagccatctatgacaaacccacagccaacattatactgaacggggaaaagttgaaagcattcccctaagaactgaaacataataaggatgcccattttaaccacttctattcaacatagtactggcagtcctagccagagcaatcagacaagagaaagaaataaagggcatccaaattggtaaagaggaagtgaaactttgctgtttgctgatgatatgattgtatacctagaaaatcctaaagacttgtacaaaaagctcctacaaagggtaaataaattcagcaaatttcaggatacaaaattaatgtacgcgaatcagtagctcttctacacaccaacagcaaccaagctaggaatcaaatcaagaactcaacccctttcacaatagctgcaaaaaagtaaaaatacataggaatatatctaaacaaggacgtgaaagaacaacaacaaaacactgctgaaagaaaacatagatgacacacacaaattgaaacacatcccatgctcatgatgaggagagtcaatattgtgaaaatgaccatactgccaaaagcaatctatagattgaatgtaatttccatcaaaataccaccatcgttctccacagaactagaaaaaacaaccctaaaattcatatggaaccaaaaaagagcccacataaccaaagcaggactaagcaaaaagaacaaatctggagggatcacattacctgacttcaaactatactataaggccatagtcatcaaaacagcatggtacttgtatgaaaaagggacagagactaatggaacaaaatagataacccagaaataaagccaaatacttacagccaattgctcttcaacaaagcaaacaaaagcatgtagtggggaaaggacactccattcaacaaatcgtgctgagataattggcaagccacatgcagaagaatgaaactggatcctcacctttcaccttatacaaaaatcaactcaagatagatcaaagacttaaatccaagatctgaaaccagaaagattctagaagataacatcggaaaaacccttgtagacattgacttagacaaagacttcatgaccgggaactcaaaagcaaatacaacaaaaacaaagataaacagatgggacttaattgactaaaaaccttctgcacagcaaaagaaataatcagcaaagtaaaccgacaacccacagagtgggagaaaatcttcacaatctatatatccaacaaagactaatatccagaatctacaaaaaactcaaatcatcaagaaaagaaacaatcccatctaagagtgggctaaggacatgaacagacaattctctaaaaaagatatacaaatggccgacaagcatatggaaaaatgctcaatatcactaatcatcagagaaatgcaaatcaaaaccacaactcaataccacctgcctcctgcaagagtggtcataatgaaaaaaatcaaaaaaataatagatgttgttgtggatgtagtgaaaggggaacacttttatactgtcggtgggaatgcaaactagtacaaccactagggcaaacagtgtggagattccttaaagaactagaagtagatctgctgttcgatccagtaattccacttctaggtatctacacagaggaaaaaagttattatatgaaaaagatacttgcacatgtttatagcagcactatttgcatatttgcaattgcaaaaaaatattagatcagcccaaatgcccatcaatcaacgagtagataaagaaaatgtggtactgtggtatacatatatcccaggggataacactcagccataaaaaggagcaaaataatgacattcacagcaacctggatggaattggagactattttttaagtaaagtaactcagcaataaaaaaccaagcatcatatgttctcactcatatgtgggagctaagctatgaggctgcaaagggataagactaatacatcagattttgaggactcaggggaaagggtggtgggtggtgagggataaaagactacacactgggtacagtgtacactgcttgggtgatgggtgcaccaaaatctcagaaatcactgctaaggaacttattcaggtaaccaaacaccacctgttccccaaaaacctattaaaaaaattttttttagaacaaagaaaaaccaacaacatatttggatatttatatttcaggtgggtttcttatagacagcatatagttgagtcttggtttttaatcttaacagtctcctattttcagttgaaatttttaggccatttctatgtaatgtgaatattgatacggttgctgtttgctttctatttgtcccattcttttctttgttcctggtttcctctttttgactgctcttgaattaattttgtttaatgattccaatttatctcaattttagcttataaacgataaccttttcagtattatttagtgattgcttaggatttatagtacacgtacatatttttcttatttttatttatacataacagatgcacatgttttcagggtacatgtgataatttgatacattcatataatgtataaagatcaaattagggtgtttgggatatacataaccttaaatgtatatatgtacatatacatacacacatataaccttaaatttaaatgtatatagagagacagaaccttaaatatatatatatttgttaaatatatttgtataaataaataatttgttatatatatttatatataaatatgtatttgttatatatatatttaaggttgtgtgtgtatacatatatatgtttaaggctgtatggccatatatgtgtgtgtgtgtatctatatatatatatatttgaggttatgtatattccaattaccctaatttcatctttataatctttaaatatattttataatctttaaaatgtatattaatttgtaaatctaattataaatctttataatttgatctttaacatatacatatattttaatgctaggaacacttgaatcattcttttctagataatttgaatgtacaatagattaatgttaactatagtcaccttagtgaactatcgaacattaggtcttagatcttttatctaactgtatatttgtctttttaatcaaccctcctccacctccccttctcagcctctggtaaccaccaatcttctctctctcttcatgaggagatctatcactttagctcacacatatatgtaagaacaggcaatatttgtctttctgtgcttgacttatttcacctagcgtaacaactcccagtttcatccatgttacttcaaatgacaggattttattctcttttatagttgaataatattccattgtgtaaatattgcagatttgctttatccattcatccattgatggacacttaagttgattccctttttttggctgttgtgaatggtgcttcaaaatacgtgactacaggtatctctttgatagattgatttcctttcttttaaatatatacctactagtggaattgctagatcatacggtaattctatttttaagtttctgaagaaactccctgctgttttccataatggctgtactaataatttacattcccaccaacagtgtaccaggtttccccttcctcaacatctttgtcagcatctgttacttccagtctttttcataaaagcattctaactggggtgagataatacatcactgtggttttgatttgcattttttatgatcagtgatgttgagcttttttttatatatacctcttggtcatttgtatgtcttctttgagaaatgttttagattttttgcccatttttaataagatattttgtggggtctttttgggtgtttgtttgtttgctattgagttttctgagctccttgtgtgttctggttattcatcccttgtcaggtggttactctgtaaatatcttctcctattctgtgggttggttcttcactttgttgattttttcctttggtgtatagaagctttttagcttgatgtgatcccatttgtttatttttgcttttgttgcctgtgcttttgagattttacacaaaatatctttgtccagaaaaatatactagaacatttccctaacgttttcttttagtagtttcatagtttcaggtttagatttaaaacttagatatgatttttaatacattttgattttttatgtggtgagagatagggatctaattccatttttctgcttatggttattcagcttttgaagcaccattttttgaagagactgtcttttccttattgtatgttctaggtaccattgagttgggtataaatgtatggatttatatccagtttccttattctgttccattggtctatgtatctgtttttatgccagtaccatacagattaactatagctgtcttgtatattttaaagttaggtagtatgatgcctgcagctttgttctttttgttcaggattgctttgactattctgggtcttttgcggttccatataattgttttttctattccttttctttgttttctttttgagacagactctcactctgtcactcaggctggagtgcagtggtgccatctcggctcattgcaacctctgcctcctgtgttcaagcaatgctcatgcctcagcctcccagtgtagctgggattacaagcatgcaccaccatgcctggctaatttttgtaattttagtagagtcagggttttatcatgttggccaggctgctctcaaactcctggccccatgcaatcttcccacctctgcctcccaaatgctgggattacaggtgtgagccactgtgctcagcctgttttttctatttctgtgaagaatatccttggtattttgatagagattacattaaatctgtaaattgctttgagtagtattgtaattttagcaatattcagtcttccaatccatgagcttggaatattttttaaatgttttatatcctcttcaatttcttttatcaatgttttaaacgtttccttgtattgatcttttactatttctttggttaaactgtttcctaggtattttatattctttgtagatattgtaaacgggattgctttcttgatttgtttttcagattgctttttgttggcgtatagaaatgctacatttgtatgctggtttttatatgttggtttttgtatcctgcgactttactgaatttgtttattgattccaatgactattttgcagagtctttatgttttccaaatataagattaagtcatctgcgcataaagccaatttgacttcttttgtcctaatttggatgccctttatctctttctcttgcctaattggtcttgccaggactttcagtattgtgttgaaaaaaagtgaaagttttgataatatgatgtatgtcatttattgacttgcatatattagacaattttgcattcttgggatgaatctcacttgacttatttcacctggcatgaatatcatggtgaattatctttttaacatgctgttgaattcagtttgctattatttcattgaggattttgcatttattttcaccagtaatattgacctgtagctttctttttttgtggtgtgtttttctggttttggtatctcagtaatcctggccttataaaataagtttagaagtattccgtcatcttcaatttgtttaaagactttgactagaattggttctgtgtttaatgttcggtagaacatcaggtcctaggctcttctttgatgagagactttttattatgacttcaatcttgttactcattattggtttattgaggtttcctattccttcatggttcaatcttggtaggttatatgtgtcaagaaatgtattcatatcttccaggttttccagtttattggtgtatagttgttcatatgtctctaacgattctttgtatttctgtagttagttgttatgtctcctttttcatttctaattttacttaattgggtctactcttttaatcttagtatagttataggtttgttgattttgtttatcttttccaaaaaccaacttttcgttttatcgacctgttttactttttgtctcaatttcactatttttctgctccaatttttattacttctttccatgtactaatttaggttttggtttattattgctttgtcagttccttaagagccatcattagcttgtttatctgaagtcttcacacctctttgataaagtcatttatggccataaacttctatcatttgttgtatcccatagatttttgtatgttgcatctccatttccatgtggttcaagaatttttataatatcctttttaatttctttatgacccattgatcatttaggaacatactgttgactttttatgtgtttctgcagtttctgaagttcctcttgttattgatttctagtttgagtccactgtggtcagaaaagacacttgttcagatttatgctcttaaatgttttgagtcttgttttgaggcctgatacatggtctatcctggagaatgttccatgtacttatgaaaagaatgtatattctgatacagttgggtgaaatgttatgggtctagtgtgtagtttaactcagatgattatttgttgacttttttgtccactactgaaagtagggtgttgatgtcccctactcttactatactgaagcctgtctttgcttaacattagacttactaatgtttactttgtacacacggatgctcctgtgtggggtgcatagatgtctatacgagtatatcctctatctgaattgatccctttatctttatattctgactttctttgtctctttttacagcattttacttgtagtctattttatcagttgtaagtatagatatttctgctatttttggtttccactttcacagaatggcttcttctatctcttcactttcagtctgtgtgtgtgtttatagtaaggtaggtttcttctagatagtatttagttgtctttgttttctatccagttaatcactctgtgtatttttattagagaattatctccacttatattcagtgttattattgatgaataaaggcttattattgctattttgttgcttattttctggctgttttataactcatttttttcttttcttcctttttttacggtcttcctttgtggttaagtgtttttctctggtagcgtgttttaatttgttgctttttattttaaatctgttttaaatttgttgctttttgttttctcagtttacatattttatattgcctatctcttaatggttgctgtaattattactgttttcgatagattagttttttcatcttcatagtagagttacaagtggattgctcatcacaattacaatattagagtattctaggtttgtctgtgtacttaattttaccagtggatttctacctgtattttttatttctttttgcacattagcgtttttttttttctttcagtctgaagaactccctttggcttttaagacaggtctaatagtggtatattttctcagcttttgttatctaggaaaaactttatttctcactcatatttgaaaaatagctttgctggatacagtattcctagatggcatttttttctttcagtgttggttcttataggatatgtttgcttagagattatttgtaatttttgaattttttcatttttatcatcttgggattctggatattttagtattaatatgaatattatttcagttctgagatacaattaaaattatttgcaaaccagtttgatctctttgcatcttgcttttaagttttgtttagcagatcacagaagtgcttagtttcagtctaatttttccccaatatggacacaaaatgttatgaggactccactcaatgacctgtgaattatgaggcatggttctttccttaactcaggtagttttgtcgggtaaagactcaaagggatcctcttcagatctctggagtgctctgcctatgcagtctttccatttccagtactctgccctataaactcatgctgctttcactttccaggactttcaacaatgaatttcttcaactcagagatacctcaggatcctacctaatatgttgtctcttcaccatgtcctagggaatctctagccagtaagatcaggcaaacttgagcctcaactaattttttttttttttatttctcagagcagtatccttcattggctgatattcaatgtcttaagaattgatgtttgatacattttatttggtttcttactttggttttcattttgctttttattttagttgttttaggcataatggtaagcccagtctctattaatcttgtcctgaagtggat

SEQ ID NO: 214 - DNA, 123533 bp, Homo sapiens
atccaaacgtctccctgaattgataacaaaatgtcagacacttaaaatcattgccatgatttcctatagtacgattacataaagctttaggtgaagtagagcatacactatgataggagaaaggaaaatcaagggattatagaatgctcccagatgcttctaaactcccccgtcagtcaaacaggacatgcttcattttcatattatgaaaaaatgagatatttctgatgtatcgcagtttaacaggagcttagctgtgagtttacaaaggtgtctttatatgtgattatacaactaaagccaggctgtgcaatgcattaaactgggtgcataacatccatttaaatatccctaaacagtacaggtaagctagtaaataaaagctctaggggagtttcaagttttaaatagcacactataaatcactagtgattatatttaatgcttatattggtcaagtgtcagtaccaaattgattattaactacatataattctacttctggctaatcagattccattggcagaaaatttgtgagtgttttaatccaatcctgatacatttgattatagatatcaatttttatttaatgcatgtaattaagagtgtgtaattccattaaaacattctaaaggctcaaaataattaaaatcaatattacataaattatgcaaatttattaaacaaagaatatatgaaaaaactacaagaaagtctatgagaatacaagccaaaagttctattgtttaatgtaactgttacacagctgaaaagtataatatttgcatacaaaaacatcataattaatatgtgataatttatgaaacagttattgatctttctatttattctattttaatcatataaattatttttcatcaaaaattctaattttaatatttttattttttattttttattataacattaattatatttttaatattttttagtggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttggtcagtagtgtataatttgttttacataattctttcaaatgaggttaatattctcttgtgcttcgtgtaaacaagagagaagttctttctctgtgtctattactttatcctgacaaaataaattaggacctaggcacattaatcaatcaccactctttcagttttttgaacaaaatacagccaaaatctttggaatattatgtaaatgtcagataacatttccattcatgcatattttaatccttgtgatgaacaagacatgaatgaagatgattattgaacaagaggatggtaacatagatatggtggaggaatatatctttgcgagtttctaatatgtttttgtttttaaataattttatttgttcaaattatactcactttaaaatccgaaatagtatttagttttatatttcaatttaagtattttatttgtttttaaccctttgattttcattcttcatttagaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggttaggccaatatgaatactcaatttctgtttatagtagaattcataaaaataatctcttgttatcaaagtgaggggaataattgagattactgcatatataaaataatttatatattataccattaaaatactttttgcatgattgaatctattctatttatgttaattttatttgttcatgatagagtcactttgtattctggcattaaaaaataatatctagtgaaattaaacctatctgtattattctcatgctgccataaagaactgcccaatactggataatttatacatacaaaaaaaggtttaattggctcactgttctgcatggctgaggaggtcttaggaaacttacaatcatggtggagggagaagcaaacgcatgaagacaggaaggagaagttctgaccaaagggaaaaggcccttataaaaccattagatctcatgaaaacacactcactatcctgagaacagaagcatggggataactgcccccattattcaactacttcctactgagtccctcccacaaaacatggagattatgggaagtacaattcaaattgttatttggttggagatacagtcaaatcctatcattccaccatggcctatcccaagtctatgtcctcacaattcaaaacacaatcatgccttcccaacagtcctccaaatcttaacttattccagcattaactcaaaagttcatatccaaagtctcatctgagacaaggcaagtcctctctgcttatgagcctgtaaaatcaaaagcaagttggttatttcctagacacaatgggggtacagggattgggtaaatgcttccattccaaaagggaggaaatggctgaaacaaagtggctatatgcttgatggaagtctgaaatttaatagggcagtcattaaaccttaaatttccaagattatctcctttgactccatgtctcacattcaggtcatgctgatgcaagagatgggctcccacagccttgtgcagatgtggctttgtccccctcctggttgctttcatgggctggcattgagtgtctgtggcttttccaggaacatagtgcaagctattgatggatctaccattctggggcttcaatgattgtggtcctgttctcacagctccacaaggcagtgcctcagtggggactctatgtgagggctctgaccccacatttcctttcctcaatggcctagcagaggttctccatgtgggctcccccctgcagcaaacttctgcctggacatccaggtattttcatatatcctctgcaacctagttgtaggttcccaaacctcaattcttgacttgtgtgcacccacaggcccaagactacatgtaatccaccaaggcttggggtttcaccctttgaggcaatggaccaagctgtttgttggccccttttagccacagctggagctgaagcagctgggatacagtcctgaggctgcatagagcagcagggacctgatccaggtccatcaaaccatttttccctcctgggcttctgggcctgtgatgggtgggggtgtcatgaaggcctctgacatgccccggagatatattccccattgtcttggtgattaactttggctccttattatttttgcaaatttctgcagcaggcttgaatttctccccagaaaaatgaagttttattttctattgcatttacaagctgcacattttccaaacttttatgctctgcttcctcttgagctctttgccacttagaagtttattctgccagataccctaaatcatctctctcaagttcaaagttccacagatctctaaggcagggcaatatgccaccagtctctttgcatagcaggagtgacctttactccagtttcaaacaagttcctcacctcatcttcatctgtgaccaccccatcctggacttcattgtccatatcactgtgagtattttggtcaaagccattcaacaagcctctaggaagtgccaaactttcccacatcttgtcttctgagccgtccaactccctaggaagttccaaacattttaacattctcctgtcttcttctgacccctccaaatggttctaacccctgcctgttatccagttccaaagctgcttccacatttttggttatctttacagcagcaccctactctctgcagtaccaatttactgtattagtctgttatcatgctgctataaagaactacccaagactgcataatttataaaggaaagaggtgtaattgactcacaattccacatggctgggaggcctcaggaaacttacaaccctggtggaagggtaagcaaacatgtccttcttcacatgatgacaggaaggagaagtgcaaagcaaagacagaaaagctccttataaaaccatcagatctcaggagaactcacgcagtatcatgagaacagcagcagaggaaaaatcgccctcatgattcaattttctcccaccaggtcccatccacaacacgtgaggattatggcaattgcaattcacgatgagatttgggtggggacacagctaaacctgttctgcaagttgtcatgtttgctttgccactatgttttaaaacttcttttacattcttcccacaatgccccttcttatttcctacaatatattatgttttacctggaatcgttaactctcaatgtgtatcttattatcactagtaagtttacagaggcattgtttaccaggcatagatgatctctttctgaaatgtattgctatttttagtttcaagtccttcttcagttggtgacagtccgatagacagacagacaccagaaggctagttttaggaaacatttgtgttacttctctgtgatgtcatagtagctcctgtattgtttattttcaaataaaactacttaatattaaaacaggcatataaaattaaatttatgagttagtgaaacctgaattcattcttttttttttaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattctcagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttataaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacgggatttttaagaaccatcatcaatttcaaaacccgtgtcctcttagtgttactccaaagaatgttgaatatgaaataagaaactttctttgtcatagttttctatgtttagcatgtattcattcggaaagatatttcttaatcctgatctaccataagcagcaatatttgttaatgttttatgtgttccttcagtaaggagaaaagaacttaaatatattactttcagtttaaaggattaaaatttcttccaggactcatttcttttaccagaaatcacaaaactgttgatattatataaagtgctgtgtttgtatttgccttatttgaacttgtattttgatttgctctcacaataaatcaagtgatgaaatgatgttttttagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatcagtgtgatgagtctgatattttgctgttggtaacaaaataatcacagattattgaacaaccattctgctgaatgcctgcctaccaaaaatttcttttagaaagtaaagtttagaaattttctctttagggctgggtgtggtggctcacacctgtaatcccagcactttgggaggccgaggcgggcagatcacgaggtcaggagattgagaccatcctggctaacatggtgaaaccccgtctctactaaaaatacagaataataataataaccggcatggtgacgggcacctgtagtcccagctagtcgggagtctgaggcaggaaaatggcgggaacccgggaggcggagcttgcagtgagccgagttcgcgccactgcactccagcctgggcgacagagcgagactccgtctcaataaaaacaacacaaaaaagtaatttttctctttatatttatattttattttaaagaatttagttgataaataaaaatatactttcatgtttgacaatatgctgttttgatatatttatgctacaatgattaccacaaattaattagcacattcttcatcacctatgcttagcattgggtgtaggtgggtgtgtgagtatgtgtgtgtgtgtttgtggtgaggacacttaaaatctgctttcttgccaattttcagataaacaatacaatattattagctctaaatatcactagatctctatgtttgattccaagttcttattcatattatagctgaaagtttgtactctttgaccaatatcttaatcaaacaaaagcagcaatgataagttctaaaatgcagggatcctaaaatgacaactgatgtaatgaatcattgataatacacccctaattctcatacattaaacataaaacctcattttcacatcgattaccattttaagtttatttaaatcaatatgatgtttttacatagtcggtttggacagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaactgttgtgtccagttcataaaatgtttgtggcaagaaattagatgcaatttttcagactttatttctgttcatcactcttaaatctctcaaagctttctccacagcttctgaggctcattgttttacagtaaacggaaaacatatcattgtctctgatttcaaaattatatcactttacaaagatgtaaaaaccaagtcaagtcttaattcatgttggtaatgagatataagtaattacaatttatcaatacataaatgcaccaaaaatgatatcaatacattaatgcaccagaactgatgaaatgtagatacttctacaagatgacaatctagcacacatgataatgcaaactaatcataagaattaaaacgtaattgggtatataaatattacaacataaacatacaaaaaataaaaatacagtatcagttataacatgctcacttgcatgcactcacttgcaaacatagaaacatgatacttttgccctgatttaatgtttatagaaaaaatattgccaggaaattcaaaactatagttaaatgtgtgtgtatatatatatatttatatgtatgtgtatgtgtgtgtgtgtatgcgtgtgcgtgtgtgtgtgtgtgtttagagatagtcggggtaaaagttagggtttaattcttttgtatatatcggtatcctctgatttttctacctttaacatatatcactttggaaacaaaagtacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttaccatataaaatcaggtggcttatatactcaggctgtctccttgttagtgatcctgatttagataaattgcttgagttgaggaaagccagatttcaaaaatctaaaggacatttgttataattagcaacttatgttgatagaaatgttaacacttaggaatatatgtttattcctaaattgttttagtacatttgggccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttactttctgatattatcaccatagtgatgaggatgtaacatacaaattttgaaagggtactactatgcacaccatagcacagcatagggataaacaaatatgttccatgtaaatggaaaccaaaagcaagcaggggggctatactaacattaactaaaattgaatttcaagtcaaatctgtaaaaagaaacaaggaaggccattatacagtaataaaggagtcaattcacaaatagattataactattgcaaatatatatgcactcaacatgggagcaatgaaacttataaagcaagcattaatacatctaaaggaagaaataaacaatgcagtaatagtaggggacttcaataacccacattcaacaatggatagacagtctatacagaaatcaataaaaacattggacttgagctctatgttagaccaaatggacctatcagacctatatagaacattccatttgacaacagtagaataaacattcttctcaagcacacaaggtataatctccaatatagatcatatgttgggccacaaaacaagtcttaaaaaattttaaaaagattgaaattacataaatttttttaacattgtcatatgaaattagaaaacaatagcagaagaaatgttaggaaattcacaaatacatggaaattaaacaacatgatcctgaacaaccaatggggcaatgaagaaattcaaagggaaatttaaaaatatcttgagaaaaacaaaaatggaaaagcaacatactaaaaaacatatggtatgcaacaaaagcagtataaagggatgtctagagatatgaatgactccatgaagatcctaataaagcaagtaactttgtatctcaggaaactagaaaatgaagaaaaaaattaacccaaagctactggaaagaaaaaaatagtaaggtacagaacagaagtaaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaacagaagagaccgctataaacagttatatgccaacatataactgttggataacctaatagaaacagatacattcatagacatctacaacctaccatgattactgaaacataatgaaatacaaaattaatacagaacagtaatgagtaagaaaaatgaacaagtaataaaaagtctctcatcaaaaacaaaacaaaacaaaaaaaaaactcgtggcttcatgacagatggaatcctaccaaacatttaaagaatcaatcctaatccttcccaaattctgtcaaaaatttaagagtgaactctcagttttattatatgagggcaaaaatcgtactgacaccaaagccacacatggatactaaaaaaaacaattagaggtcaatattcttcatgaatatagaggtaaaaatgctcaacaaaatacctccaaagtgaacacaacacattaaaagaatcactcgccataatgaaaggggatgtatatctgggatgtaaagatagtatacatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaagctcacatttaacattatactcaagagtgaaaagttgaaacatttttgtctatgatcagaaaaaaaaaaaaaaaacaaggaggctcactctcaccacttctgttcaacatagtgctggaaatcctggctagagctattaggcatggaaattggaaaagaagacagttgtctctgtttgcagatgacatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtacactgaaaactataaaatattgatgaaagaattgaagaaaacacaaataaatgaaaagatgtcctgtcttcaaggatcaaaagaatcaatattataaaattgtcttcaatacctaaaactccagattccatgcaatattgtcaatattctaaacacatctttcacagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctgggactatatccatgttaagcagtctttttcacataattaactgaaacaatgggtaccctttgtaagattttttaaaattaggcaaaataaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcacaaactgttgccatgatgttttctcctgactggcctgcttttgctttcatcggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcgtctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgtatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagctgactctgagtgcgaatcttcttttcaaaaatgatttaaatacttcttatctctggttcaccctattaccgaatccatagagttgtatattaattttcacttgttttcttcattcttagattttgcttttttcattcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatgggtaaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcaagatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccgctgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaatcatcaagtgttatcaaacatgtggagaaaaggacacacttgcacattgttgatggaaatgtatattagtatagccattatggaagatactatagagtttgtcaaaaatgaaaagcagaacatataatcaatccagtaatcctactactgaatatatgtacaaagaaaaaggaatcagtatgtcaaagagttatctgcattcccatgttcattacagcattatttataatagccaaaatgtggaatcaacttaagtatccattacagatgaatagataaagaaaatgtggtctatatacacaacgtaatactattcagctttgaaaaaaggaaatcctgcattttcaagaacatagaataaacagggaggacattaagttaggtggaataagacagacaaaaccacatgattgcacttatacgtgcaatccgttgtaaaatatggtgactttagttaacaataatatgttgtattcttgaaaactacttagtgtagattttaagcagtctcaccacacacaaaaatgagaagtatgtgaagtaaagcatatatttattagcttaatttagccattatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaaaaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataatagtgataatattatatatttcaatattgctgagtacatatattctatttaatatatttaagcctagcctttctaactactacagaaagagaagctaaatgtctgttgtaagtatgcttatcttacaaaaaataagttcatttgatattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaatatttatttctcctttttatagaatttcaaaatcaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcatgtgcacatcataggtgtacagtaggtgtatgtattgatggagtacttagaatgttttgatacaggcatacaatgtgaaataagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctatttttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaattccacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagatatcgcttccatacactgatttccatacactgctgatgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaactgttaattgcagagactcttttccacagcgttcctttgtcaaaaatgcattcactgtagatgtgtaaatttgtttctgtgttttctattctgttccattagactgtatgtctgtttttatgccagtactatcctgttttagttactacaactctgtagtataatttgaagtcaggtaatgttattccttcagttttgtttttattgcttaggatagctttagctatttttggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatctttttttttttggtgtcctcttctacttctatttttagtgttttactctttttcttatagagatctttgacttctttggttaatatctaattatttatttttatctgtggttactgtaaatgggattacctttaggatttttttcagattgtttgctgtcaacatatacaagtgctactggttttttatgttgatattatatcttgcacccttactggacttatcagttctaatagttttctggtgattaccttacgtttatcgaaaaaaacttataccatctgcaaacaaagataatttggcttctttcgtttcaatttggatacctttatatccctctcttgtctaactgctgtagccaggacttccagtattatgttgaataacagtggtgaagtgggtatccttgtcatgttccagtactttgaggaaattatttcagactttctccattcagtatgatagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtgtatgttgagccatctttgcatctcaaggataaatcccatttggtcatgttgaatgatctttctagtatgctgttaaatttgttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaacgttagggagaattcaacagtgaagccaatatgtcctgagcttttctttactatgaaactttttattctggctttgatctcattacttgaattaataattgatctgttcaggttttggatttctttctgcttcaatcttagtaggttttatgtgtctaggaatttgtccatttcttctagattttccaatttattggaatatcattccacatagtggctaataatgattctttgaatttctccaggatcagatgtaatgtttccttttcatttctgattttatttatttgaattctcactctttttctcttagtctggataaaggttgatcagcatgtttagtattttaaaataagaacttatgtttcattgatctttgtattttattcatttcaatttcaagtttatctgctgtgatatttattatttattttcttctaataattttggatttggattgcccttccttttctagttcattaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccacagtgcattcaggggcatattctttaatttccagattctttaattttttgtttcaacttaccatatggattgcaaatactatcttaaaaccagaaaacataacactgtttgcataaacaaacaagccaaagtaaactcataaatactttccaccttaattttcccttctgctttcaaactttttgttgtttctatttttatcttattttacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattatttattgttcatgaatttcgttttttgattgaaatattccctttagcatttcttgtaggacaggtctggcataataaaattcctcaccttttccttatctgagaatgtctttatttcttctttatgtttaagggatattttcaccagatattctactctaggataaacgtcatttttctgtcagcatgtgtcatatcactcctgtaaggattcctctaaaaagcctgctaccagatgtattggtgctccgttgtatgttatttatttctttgttcttactgattttagaatagtctctttatccttgaccttagagaatttgattattaaatgagttgaggtagtcttctttgggttaaatctgcttggcattctataaccttcttgtacttgatatagatctcattctctaggtttgggaagttctttgtgattatccatttgaataaactttctactcctatctcgttctctacttcttccttaaggtgaatactctcagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacatgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccagcaatgcagtggttcttgcagacttctaggggtactgtattgatggtcttgcacatgatctgagagaattcagggtgatgagggcccctggaccagggtggtttccaggggaccagtttcaaaaaccttagatgtctgcttgatgttatatggtactgtatctgggctggcagtcatattgcaagttaaaatgttgtggggtggggtggggggatgggggagggatagcatttggagatatacctaatgttaaatgacgagttactgggttcagcacaccaacatggcacatgtatacataggtaactaacctgcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccacggtatgtccaaaaatgccacccaccagtcaagtccaggaactggggaccctgggagcccaggtggttctctacccactgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcacgctcttggctgcctcagctggtgcagttggtgtctctgaatattctgtgtcttcccccagtccatagtctctgagcctagttcagcactaggactcacatacgtgtgcagtccttatgtcctagactgtctttctagtttatttagagacacaatgcatggtaggtagccctaggtggcaagatttgtgggaacttgatttcagacccctgcggtcagcaataccatcatggctagcattggtttaagtactccctccatgggaaggggttagctgagtttggtttggttttcctttctgctctaacagcacagcattttgttcaatgcctcacaattgctatgttctccctccctcagtgcctagagcaaggctctgtacaccatggcacagctgcaagtgtggggagaggggaaagggtagtgtcagtgattcaagattgtctgacctatctcttacgtgccactttcagggatatgaagttaaaaccatgtactatgagtgctaatctgataatgttttcattttatgaaggtgttttttttttttttttctgtgtacatagttgttaacttagtatctttgaaggggaatggttggtgtctcctattccaccatctggctctgctctgcctaatttgtggaaactctttatcatgaagaaatgtcaaagtttctcaaatgtttttagtacttctatgaaaatgatcatatagttttgttcattctgttattgtgatatgttacatctattggtttgtgtatgtctacccatctttattttatgcatagtttgaaaaacagtactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaagacaaggcattatctggtagcagctgctggtagcagctgagatcaccaacagtagctttccttgcttctggaagttttcctaaaaaacatccactgcagtacaatggataattagtggggcatcactaagattcctgaacttcggaattttctggaaatagcatttttgacctttgttccctcagttcttccaatagttgtggaagcctttcgttccctttattgatactctctttactcaaaaaatgagaaataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaacaatgaaagatttcaaactccaaacagtacaactgaaacttttgcattactatactactgagaatatctaacatgttgttactaattaatgtcattctcaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcattatgctagtagaaatagcatattttgtaagactataacagaaattaattttatgaaatattatctcattttaacttaaacaatgaataatattctctttgtttcataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatataccaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataaataattattttttatagctttatgttattgttcactgatttgttttctcctcaacagtcatatattttctatattaactatctttttgaatgcaggccttgcatattaaagaactatatcgtaacattagcagtggaaccacatgagtcaaaaatcatggacaatcaagggtttgtggccattaatgaagaatataaattttgtaattatccgaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacgatttgctagttttatttgttgtgcaaaatcaaacttgatctgtgccaaaatggaaagaaaaggaaattctcctgttatttcctttgttaactgaactgatacaggtacatttttttcaaataaagattaaatagattaaaatagaatgaaaagaagaaaagtagtaccattttgaaatgactggaattagagaagcatatgcactatactttcttacttactttcttaaaagcactataaaaaaagaatgatgacaaattcttccttatctgatattccagttgaaaacttttctcctccaatgaactttttgtaagagtaaacttgagcaaaatgtcttgtaaatttaggtcgcacctatatttctcaaaggagaaagtaactcattgggttaccttcaacgtcttggttagagagaaacatctttgtgtattcagtagcattggctcaactgcatcccgccaaaattcatttgttaaagtccaaattcccaatacctgagaatgtgactgcatttggagaaggagtgcttaaagatgtaattaagttaaaggtcaatggttcaggtgggtcctactccaatataactggtgtctatataagaagagaaaataagaacacaccatatagagaaagatcacgcaaggcatagaaaggatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataactttttactttttactcaagagtatatatatatatatgtagccaccacacagattttagaggctattcatcagaatttggtaattatatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacattaaaatcggcacaccaattcttttggaaaccacactatttgaaagacaaactcgacagaaaatttgtaattgtaacctattataatgttcattgaatttgtattggccattatttcttccattaagtcataagttatttatacttatttaaagataggttgtcaagagcattatttttaattatgaatatcctttcagaattgtataaactttatattcatctactagagttgccataacaaagtgtcaagggtgacaattagtaatgtagagcagggttgcttctaaatcccttttaaactgatcattttcagtacccaatgcattacagttaattgccattgtacttctttgggatgctcaaatttgtttcaaatctcactaagaagctggcttttgtgtatatttcatgtgcccccattaagctttggcataacaaaaggtcccatgctttccttgacttttgctactacagactaactttcaataatttctgtatgaaattccagtgccttttagtgggaaaaacgatttttagaaacaaacctaaactatgaaaaactcacttcaggtttgaaattatcgttgactaagaaaaataatatttggccgagtggggtggctcacaccttcatcccagcactttggagggccaaggcgcgcagatcacttgagaccgggagttggagaccaacctggccaacatgatgaaatgctttctctactaaaaattcaaaaaattagcaggatgtagtggcacacacctgtaattccagcttctcaggagactgaggcaggagtatcatttgaacccaggaagcagaggttgaagtgagctgagatcgcgccactgcactctagccttggcaacagagcaagactgttaaaaataaaaataaagaaagatttaaatgatttcctttaattaatgtccctttcttcctcggactaaatatcctgcaatcataagaaaatgtaaaagtatctcaggaggttacacagggcacggaagtttcgattttccaatacggaggagacagcagaaaactgtgcagccatgcttgaggggctgggtcagacaagctgtcatgcgtcacctaacaagcctctagggccagttctgtaactagcaaacgcttccctcaaagtaaagatgtcacgtctatgaacttagtcttctcatctgcacactaaagctgttgtgccactagcttccttcccgttctctctgatttatgatgattcaaacttaaagatttttctttagttatattcttaagttctcataacaaatagaatgtaaatactattttctatcacttgttccataattatagaagaaacataaattatatgctatttaaattgtggtgttgttcaacattctataggtatacatacctatagaatataagaatatatatatatttgtacattcgtctatgcacctattttttatgtcaataatatgtctcatctgatacatgaattctaactatggtaagaatgcatgccatcgcatacaaacaaaatgccacaaaactaaacaaaatgttttatatctggagataatttgctacatttcagatttttttatgctacagtcatatttcttgtctctcttttccaaaacacaatcattgctgatgtgtgcaccctaaactgacagcttgagcttaacttggtatagttgtagataagttcagtttaaattaatgctgataaaacctccagaattgctgaagagaccatactatgttagtagaagtagagaaagtgaaatgagcttcttgtcctgttagctgacttgagttccattaaagattttaagtggagaaataaaatgaccagatgaaaggtcattaatttatacacaggaaaatagattataaagatgagaggtcaggatcaggaaactagttacggttgctgtaatctcagaagaatttggttgagagacgatgatatcaaaggttattgccagggtttttttatgcctgttgtgtttatttgtttgtttgttttgacagaaaaaaattgagtgaaagggaataccacaattgcagaagttcagttattattgagagaggtaatgagaatgattgacatgaatttcccccaaaaaatgttctgtcaataattactatattacgaataaatagagcatggaatatttttacagctgactcagagaaaatagctattacagcaaacctatgtctatattgaaattcatatatacattcaaagaatattactctataccatttatctcaagagaactaatcttcaaagcaaaagaaatcagcaacatgtttttaattaaaattttaacttccttcaaaaatgtcttttgggccaggcgcggtggctcacgcctgtaatcccgacactttgggaggctgaggagggcggatcacgaggtcaggagattgagacgatcctggctaacacggtgaaaccccgtctctactaaaaaatatacaaaaaaaattagctgggcatggtggcgggtgcctgtagtcccagctactcgggaggctaaggctggagcattgcgtgaatccaggaggcagagcttgcagtgagcggagatcgagccactgcactccagcctgggcaactgagcaagactctgtctcaaaaaaaaaaaaaaaaaaaagtcttttttatttatctgttaagaacagataaatcattcatgcggcattcaagtcaaaaaagaattttttgttgttggcagatttacctagtggaaacaacatttgtatttagcttctaaagtaaattaagtggaggaaaatgaagattttcattaataaccttaatattaatagacaatggtggtactgaggagaacatctatctcttttaggcttcatgaggaaatgatgtttttcagtgtcgacaaattaatttcagctgtgtggtttgcccaccaaatatcatgcctgtaataatatactgtacttagcctaccatattttaaaatgattggtttccaactatcaaggcatagaagagaatatatagatagttgaagagttaaagaaattatagcataagaagcatgcaaaaagatacagttatagcattataatgactgtcttgagatatttgaaaacatttatgaaggggagcaagttaacttttgatgaggactgtcacagtcagtgaagcaggtaacagtattatccaacatcgaatcagaggtcaagtgattttctaaaagtgtgacctatacggatattgccatatgtcgggggtgggggtagaagagttgatctcttctgagccctccacgttttaagttgtatgattcaaaattatacatacaaaccttgtttttattacactctattttaaaaactgcagttatcttttgagttgattttataatttatttttgttttaattgctaatgagctcagaagcagttccttggaaaatatatttcactacacaattcagatatcttcacttgtaagcactgttaagaaaaatatgttagacagaagttaatgaggttaaagagtcaccactttctttctccaggctgcgtagatgacatctatgaaatgcgtttgccttgcagttccctgtcaaatttcttctatgtggagccgcctccctcagctcaaaacacacatttcagctctcctgctctctcctacaggaacactgctgttctgtgtaaagaggaggtagggccttgtctttcacgcaagcctggctcaattgggcacctcaccactggggttgcagccaccgctaatccccctagaatgtctgtcctctggtgtgtctgcaccagtctcctttgcgagtgaccacagctatgtccacagaattgggtgcaggggagatgtccccctctctacatctgtgcccaagcactggggccacctgtctcctaggatggatctatactcccttgcaaggcaagcacggtgcctgtgtgcctgctgaaagtggtctagtcactttcagcccacaagcaggtttctcttgcacacaggaaagtggaatgaacaaaattaggaatcaacaaaaaaagtttatcataatcttaactatttggatattaagaaatattcctagtctatttctgcggtttaataaacactggaaatcttggctcagtgacttgtttgaggcgtgaattagctgtgttatttttctgtgcggtattatcaaagaaaaatttttgtgttcctcaatatgtttatattgtccagtaattagaaaagagcctagtgaatttatttgttttctatttttatttttattttttgagatggagcctcactctgtcacccagactggagtggaatggcgcaatctcaattcactgcaaactctgcctcctgggttcaagcgattctcctgcctctgcctcctaagtagctggaattacaagggcgcaccaccaggcccagctaattttttttgtatttttagtagaaacgggtttcatcatgttggccaggctggtctcgaagtcctgacctcaagtgatctgcctgcctcaacctcccaaagagctgggattataggcatgagccaccgtgcgcagcccatgaatttaatccaaaacaataaaaaccttaaatccctcaaaatactacctccttacattgaatttttctgagaagaaaatacagggctctgtttactgatgacagtagaaaagaaaaaaaaaaggaatacctgagctaagtgataaaattgacatatttctcaaccaaaaagctcatttaattagccagaggtagggtatatgtactcaaggggaatacattaaataggtttgtacatttttccttctagagagccttcctacaaatttatgcatcacgtgatccacaagacataatctcatcttcattagcaaagaccttctcgtcacatatcttagtcatctgagttctatcatttgttttgacctagaaaccctaatggaatgtgtaattattctaagaagagaatataattcagtgataaaaaaatttatctctaatatgattatttattacagtaaaaagtattcatacttttttttgttttttattgcaagtgaaatcttgtgattttccagacattaaacatggaggtctatattatgaaagtatgtgtagaccatactttccagtagctgtaggaaaatcttactcctattactgtgatgaatcttttgagactccttcaggaagttactaggattacatttattgcacacaagatgggtggtcgccagcagtaccatgtctcagtaagtaaacctctggacagccatatatgtataaaactttcaaagattgaagagaggagagcacataagtgattacacttgacttatataacagaaatagggccaagaaaagagttgttcaagcaaaatgaccaaaatagatcttttctattatgagttcttaaaaatcacgagaaataaatatagagactttatgagaatatctatataattgatacatattttaattataaaaacttaagtagtattaaatattgatatttctttttgtacaaacctttgttagtaattttagttcatattcagttatacattgtttttggatgtttatgcaatcttatttaaatattttaaaaataattgtaatatactattttgagcacatttttgtgtctcatttactttattcatttatcattgttatcgtccttaggaaaacgttattttccttatttggaaaatggacataatgaaaattacggaagaaagtttgtacagggtaactctgtagaagttgccttccttcctggctgtggtcttccaaatgagcagaccacagttacatgtatggagaatggctggtctcctccttgcagatgcatccgtgtcactaagtacactactctgagatcccagcaagttcatgtctttctaagtaacacagatgacatgctaagactcatctatattaactgcggcaaaatatttatgtcaacttgcttcgccatcggacctatttagttttattttttcaattctgtataaacaaatatacacatttcttgataagttcatagtaaaataaatgctcctattattgggcattagtcaagaatacagtaaaagagtttgaaaacaatacttgttggttaaattaagacatattgaaatggcatcattgtctggagtaaatacccgaggtttctcatctggcactgagaagattaaggacatggacacacacaaggagtgggcgtaggatcgcaggtttaataggcaaaagaaagagaaaggagaacagctctgtctcttgtgagagagaggggcacccaaaagtgaattctggccccggctggggtgcactggattttataaacaggcttgaggaagcagtgtctgatttacatagggcccaaagattgattggaccaggtgtgatatttacataatgtgctaggaagctggctgccccaccctaatcttattatgcaaatgggatctttgcctggccagcgccatgttgccttttccttactgtacacgtggctggcaaagagaagggaagatggagttgccatatgaacatgcctagtcccaggtagccttttcctattggcacaactgctgccattcaccttgcaagcttccaacttgcttgtctatgtttacatctctgttttacaggttccactttgttagaaaaagaaatgatttgggggctcctattattaaaaggaaaactttaccaaggactcctgtaccctcattatctgcctaaataatttcttcttaactcgtgtatcaatattaatatgtactttggaatcaatcatttgactcaaaatgattatacatttatagtttaaaatagaaagtgagtacaat

SEQ ID NO: 215 - DNA, 116939 bp, Homo sapiens
aacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacgggatttttaagaaccatcatcaatttcaaaacccgtgtcctcttagtgttactccaaagaatgttgaatatgaaataagaaactttctttgtcatagttttctatgtttagcatgtattcattcggaaagatatttcttaatcctgatctaccataagcagcaatatttgttaatgttttatgtgttccttcagtaaggagaaaagaacttaaatatattactttcagtttaaaggattaaaatttcttccaggactcatttcttttaccagaaatcacaaaactgttgatattatataaagtgctgtgtttgtatttgccttatttgaacttgtattttgatttgctctcacaataaatcaagtgatgaaatgatgttttttagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatcagtgtgatgagtctgatattttgctgttggtaacaaaataatcacagattattgaacaaccattctgctgaatgcctgcctaccaaaaatttcttttagaaagtaaagtttagaaattttctctttagggctgggtgtggtggctcacacctgtaatcccagcactttgggaggccgaggcgggcagatcacgaggtcaggagattgagaccatcctggctaacatggtgaaaccccgtctctactaaaaatacagaataataataataaccggcatggtgacgggcacctgtagtcccagctagtcgggagtctgaggcaggaaaatggcgggaacccgggaggcggagcttgcagtgagccgagttcgcgccactgcactccagcctgggcgacagagcgagactccgtctcaataaaaacaacacaaaaaagtaatttttctctttatatttatattttattttaaagaatttagttgataaataaaaatatactttcatgtttgacaatatgctgttttgatatatttatgctacaatgattaccacaaattaattagcacattcttcatcacctatgcttagcattgggtgtaggtgggtgtgtgagtatgtgtgtgtgtgtttgtggtgaggacacttaaaatctgctttcttgccaattttcagataaacaatacaatattattagctctaaatatcactagatctctatgtttgattccaagttcttattcatattatagctgaaagtttgtactctttgaccaatatcttaatcaaacaaaagcagcaatgataagttctaaaatgcagggatcctaaaatgacaactgatgtaatgaatcattgataatacacccctaattctcatacattaaacataaaacctcattttcacatcgattaccattttaagtttatttaaatcaatatgatgtttttacatagtcggtttggacagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaactgttgtgtccagttcataaaatgtttgtggcaagaaattagatgcaatttttcagactttatttctgttcatcactcttaaatctctcaaagctttctccacagcttctgaggctcattgttttacagtaaacggaaaacatatcattgtctctgatttcaaaattatatcactttacaaagatgtaaaaaccaagtcaagtcttaattcatgttggtaatgagatataagtaattacaatttatcaatacataaatgcaccaaaaatgatatcaatacattaatgcaccagaactgatgaaatgtagatacttctacaagatgacaatctagcacacatgataatgcaaactaatcataagaattaaaacgtaattgggtatataaatattacaacataaacatacaaaaaataaaaatacagtatcagttataacatgctcacttgcatgcactcacttgcaaacatagaaacatgatacttttgccctgatttaatgtttatagaaaaaatattgccaggaaattcaaaactatagttaaatgtgtgtgtatatatatatatttatatgtatgtgtatgtgtgtgtgtgtatgcgtgtgcgtgtgtgtgtgtgtgtttagagatagtcggggtaaaagttagggtttaattcttttgtatatatcggtatcctctgatttttctacctttaacatatatcactttggaaacaaaagtacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttaccatataaaatcaggtggcttatatactcaggctgtctccttgttagtgatcctgatttagataaattgcttgagttgaggaaagccagatttcaaaaatctaaaggacatttgttataattagcaacttatgttgatagaaatgttaacacttaggaatatatgtttattcctaaattgttttagtacatttgggccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttactttctgatattatcaccatagtgatgaggatgtaacatacaaattttgaaagggtactactatgcacaccatagcacagcatagggataaacaaatatgttccatgtaaatggaaaccaaaagcaagcaggggggctatactaacattaactaaaattgaatttcaagtcaaatctgtaaaaagaaacaaggaaggccattatacagtaataaaggagtcaattcacaaatagattataactattgcaaatatatatgcactcaacatgggagcaatgaaacttataaagcaagcattaatacatctaaaggaagaaataaacaatgcagtaatagtaggggacttcaataacccacattcaacaatggatagacagtctatacagaaatcaataaaaacattggacttgagctctatgttagaccaaatggacctatcagacctatatagaacattccatttgacaacagtagaataaacattcttctcaagcacacaaggtataatctccaatatagatcatatgttgggccacaaaacaagtcttaaaaaattttaaaaagattgaaattacataaatttttttaacattgtcatatgaaattagaaaacaatagcagaagaaatgttaggaaattcacaaatacatggaaattaaacaacatgatcctgaacaaccaatggggcaatgaagaaattcaaagggaaatttaaaaatatcttgagaaaaacaaaaatggaaaagcaacatactaaaaaacatatggtatgcaacaaaagcagtataaagggatgtctagagatatgaatgactccatgaagatcctaataaagcaagtaactttgtatctcaggaaactagaaaatgaagaaaaaaattaacccaaagctactggaaagaaaaaaatagtaaggtacagaacagaagtaaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaacagaagagaccgctataaacagttatatgccaacatataactgttggataacctaatagaaacagatacattcatagacatctacaacctaccatgattactgaaacataatgaaatacaaaattaatacagaacagtaatgagtaagaaaaatgaacaagtaataaaaagtctctcatcaaaaacaaaacaaaacaaaaaaaaaactcgtggcttcatgacagatggaatcctaccaaacatttaaagaatcaatcctaatccttcccaaattctgtcaaaaatttaagagtgaactctcagttttattatatgagggcaaaaatcgtactgacaccaaagccacacatggatactaaaaaaaacaattagaggtcaatattcttcatgaatatagaggtaaaaatgctcaacaaaatacctccaaagtgaacacaacacattaaaagaatcactcgccataatgaaaggggatgtatatctgggatgtaaagatagtatacatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaagctcacatttaacattatactcaagagtgaaaagttgaaacatttttgtctatgatcagaaaaaaaaaaaaaaaacaaggaggctcactctcaccacttctgttcaacatagtgctggaaatcctggctagagctattaggcatggaaattggaaaagaagacagttgtctctgtttgcagatgacatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtacactgaaaactataaaatattgatgaaagaattgaagaaaacacaaataaatgaaaagatgtcctgtcttcaaggatcaaaagaatcaatattataaaattgtcttcaatacctaaaactccagattccatgcaatattgtcaatattctaaacacatctttcacagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctgggactatatccatgttaagcagtctttttcacataattaactgaaacaatgggtaccctttgtaagattttttaaaattaggcaaaataaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcacaaactgttgccatgatgttttctcctgactggcctgcttttgctttcatcggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcgtctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgtatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagctgactctgagtgcgaatcttcttttcaaaaatgatttaaatacttcttatctctggttcaccctattaccgaatccatagagttgtatattaattttcacttgttttcttcattcttagattttgcttttttcattcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatgggtaaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcaagatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccgctgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaatcatcaagtgttatcaaacatgtggagaaaaggacacacttgcacattgttgatggaaatgtatattagtatagccattatggaagatactatagagtttgtcaaaaatgaaaagcagaacatataatcaatccagtaatcctactactgaatatatgtacaaagaaaaaggaatcagtatgtcaaagagttatctgcattcccatgttcattacagcattatttataatagccaaaatgtggaatcaacttaagtatccattacagatgaatagataaagaaaatgtggtctatatacacaacgtaatactattcagctttgaaaaaaggaaatcctgcattttcaagaacatagaataaacagggaggacattaagttaggtggaataagacagacaaaaccacatgattgcacttatacgtgcaatccgttgtaaaatatggtgactttagttaacaataatatgttgtattcttgaaaactacttagtgtagattttaagcagtctcaccacacacaaaaatgagaagtatgtgaagtaaagcatatatttattagcttaatttagccattatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaaaaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataatagtgataatattatatatttcaatattgctgagtacatatattctatttaatatatttaagcctagcctttctaactactacagaaagagaagctaaatgtctgttgtaagtatgcttatcttacaaaaaataagttcatttgatattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaatatttatttctcctttttatagaatttcaaaatcaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcatgtgcacatcataggtgtacagtaggtgtatgtattgatggagtacttagaatgttttgatacaggcatacaatgtgaaataagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctatttttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaattccacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagatatcgcttccatacactgatttccatacactgctgatgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaactgttaattgcagagactcttttccacagcgttcctttgtcaaaaatgcattcactgtagatgtgtaaatttgtttctgtgttttctattctgttccattagactgtatgtctgtttttatgccagtactatcctgttttagttactacaactctgtagtataatttgaagtcaggtaatgttattccttcagttttgtttttattgcttaggatagctttagctatttttggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatctttttttttttggtgtcctcttctacttctatttttagtgttttactctttttcttatagagatctttgacttctttggttaatatctaattatttatttttatctgtggttactgtaaatgggattacctttaggatttttttcagattgtttgctgtcaacatatacaagtgctactggttttttatgttgatattatatcttgcacccttactggacttatcagttctaatagttttctggtgattaccttacgtttatcgaaaaaaacttataccatctgcaaacaaagataatttggcttctttcgtttcaatttggatacctttatatccctctcttgtctaactgctgtagccaggacttccagtattatgttgaataacagtggtgaagtgggtatccttgtcatgttccagtactttgaggaaattatttcagactttctccattcagtatgatagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtgtatgttgagccatctttgcatctcaaggataaatcccatttggtcatgttgaatgatctttctagtatgctgttaaatttgttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaacgttagggagaattcaacagtgaagccaatatgtcctgagcttttctttactatgaaactttttattctggctttgatctcattacttgaattaataattgatctgttcaggttttggatttctttctgcttcaatcttagtaggttttatgtgtctaggaatttgtccatttcttctagattttccaatttattggaatatcattccacatagtggctaataatgattctttgaatttctccaggatcagatgtaatgtttccttttcatttctgattttatttatttgaattctcactctttttctcttagtctggataaaggttgatcagcatgtttagtattttaaaataagaacttatgtttcattgatctttgtattttattcatttcaatttcaagtttatctgctgtgatatttattatttattttcttctaataattttggatttggattgcccttccttttctagttcattaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccacagtgcattcaggggcatattctttaatttccagattctttaattttttgtttcaacttaccatatggattgcaaatactatcttaaaaccagaaaacataacactgtttgcataaacaaacaagccaaagtaaactcataaatactttccaccttaattttcccttctgctttcaaactttttgttgtttctatttttatcttattttacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattatttattgttcatgaatttcgttttttgattgaaatattccctttagcatttcttgtaggacaggtctggcataataaaattcctcaccttttccttatctgagaatgtctttatttcttctttatgtttaagggatattttcaccagatattctactctaggataaacgtcatttttctgtcagcatgtgtcatatcactcctgtaaggattcctctaaaaagcctgctaccagatgtattggtgctccgttgtatgttatttatttctttgttcttactgattttagaatagtctctttatccttgaccttagagaatttgattattaaatgagttgaggtagtcttctttgggttaaatctgcttggcattctataaccttcttgtacttgatatagatctcattctctaggtttgggaagttctttgtgattatccatttgaataaactttctactcctatctcgttctctacttcttccttaaggtgaatactctcagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacatgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccagcaatgcagtggttcttgcagacttctaggggtactgtattgatggtcttgcacatgatctgagagaattcagggtgatgagggcccctggaccagggtggtttccaggggaccagtttcaaaaaccttagatgtctgcttgatgttatatggtactgtatctgggctggcagtcatattgcaagttaaaatgttgtggggtggggtggggggatgggggagggatagcatttggagatatacctaatgttaaatgacgagttactgggttcagcacaccaacatggcacatgtatacataggtaactaacctgcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccacggtatgtccaaaaatgccacccaccagtcaagtccaggaactggggaccctgggagcccaggtggttctctacccactgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcacgctcttggctgcctcagctggtgcagttggtgtctctgaatattctgtgtcttcccccagtccatagtctctgagcctagttcagcactaggactcacatacgtgtgcagtccttatgtcctagactgtctttctagtttatttagagacacaatgcatggtaggtagccctaggtggcaagatttgtgggaacttgatttcagacccctgcggtcagcaataccatcatggctagcattggtttaagtactccctccatgggaaggggttagctgagtttggtttggttttcctttctgctctaacagcacagcattttgttcaatgcctcacaattgctatgttctccctccctcagtgcctagagcaaggctctgtacaccatggcacagctgcaagtgtggggagaggggaaagggtagtgtcagtgattcaagattgtctgacctatctcttacgtgccactttcagggatatgaagttaaaaccatgtactatgagtgctaatctgataatgttttcattttatgaaggtgttttttttttttttttctgtgtacatagttgttaacttagtatctttgaaggggaatggttggtgtctcctattccaccatctggctctgctctgcctaatttgtggaaactctttatcatgaagaaatgtcaaagtttctcaaatgtttttagtacttctatgaaaatgatcatatagttttgttcattctgttattgtgatatgttacatctattggtttgtgtatgtctacccatctttattttatgcatagtttgaaaaacagtactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaagacaaggcattatctggtagcagctgctggtagcagctgagatcaccaacagtagctttccttgcttctggaagttttcctaaaaaacatccactgcagtacaatggataattagtggggcatcactaagattcctgaacttcggaattttctggaaatagcatttttgacctttgttccctcagttcttccaatagttgtggaagcctttcgttccctttattgatactctctttactcaaaaaatgagaaataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaacaatgaaagatttcaaactccaaacagtacaactgaaacttttgcattactatactactgagaatatctaacatgttgttactaattaatgtcattctcaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcattatgctagtagaaatagcatattttgtaagactataacagaaattaattttatgaaatattatctcattttaacttaaacaatgaataatattctctttgtttcataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatataccaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataaataattattttttatagctttatgttattgttcactgatttgttttctcctcaacagtcatatattttctatattaactatctttttgaatgcaggccttgcatattaaagaactatatcgtaacattagcagtggaaccacatgagtcaaaaatcatggacaatcaagggtttgtggccattaatgaagaatataaattttgtaattatccgaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacgatttgctagttttatttgttgtgcaaaatcaaacttgatctgtgccaaaatggaaagaaaaggaaattctcctgttatttcctttgttaactgaactgatacaggtacatttttttcaaataaagattaaatagattaaaatagaatgaaaagaagaaaagtagtaccattttgaaatgactggaattagagaagcatatgcactatactttcttacttactttcttaaaagcactataaaaaaagaatgatgacaaattcttccttatctgatattccagttgaaaacttttctcctccaatgaactttttgtaagagtaaacttgagcaaaatgtcttgtaaatttaggtcgcacctatatttctcaaaggagaaagtaactcattgggttaccttcaacgtcttggttagagagaaacatctttgtgtattcagtagcattggctcaactgcatcccgccaaaattcatttgttaaagtccaaattcccaatacctgagaatgtgactgcatttggagaaggagtgcttaaagatgtaattaagttaaaggtcaatggttcaggtgggtcctactccaatataactggtgtctatataagaagagaaaataagaacacaccatatagagaaagatcacgcaaggcatagaaaggatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataactttttactttttactcaagagtatatatatatatatgtagccaccacacagattttagaggctattcatcagaatttggtaattatatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacattaaaatcggcacaccaattcttttggaaaccacactatttgaaagacaaactcgacagaaaatttgtaattgtaacctattataatgttcattgaatttgtattggccattatttcttccattaagtcataagttatttatacttatttaaagataggttgtcaagagcattatttttaattatgaatatcctttcagaattgtataaactttatattcatctactagagttgccataacaaagtgtcaagggtgacaattagtaatgtagagcagggttgcttctaaatcccttttaaactgatcattttcagtacccaatgcattacagttaattgccattgtacttctttgggatgctcaaatttgtttcaaatctcactaagaagctggcttttgtgtatatttcatgtgcccccattaagctttggcataacaaaaggtcccatgctttccttgacttttgctactacagactaactttcaataatttctgtatgaaattccagtgccttttagtgggaaaaacgatttttagaaacaaacctaaactatgaaaaactcacttcaggtttgaaattatcgttgactaagaaaaataatatttggccgagtggggtggctcacaccttcatcccagcactttggagggccaaggcgcgcagatcacttgagaccgggagttggagaccaacctggccaacatgatgaaatgctttctctactaaaaattcaaaaaattagcaggatgtagtggcacacacctgtaattccagcttctcaggagactgaggcaggagtatcatttgaacccaggaagcagaggttgaagtgagctgagatcgcgccactgcactctagccttggcaacagagcaagactgttaaaaataaaaataaagaaagatttaaatgatttcctttaattaatgtccctttcttcctcggactaaatatcctgcaatcataagaaaatgtaaaagtatctcaggaggttacacagggcacggaagtttcgattttccaatacggaggagacagcagaaaactgtgcagccatgcttgaggggctgggtcagacaagctgtcatgcgtcacctaacaagcctctagggccagttctgtaactagcaaacgcttccctcaaagtaaagatgtcacgtctatgaacttagtcttctcatctgcacactaaagctgttgtgccactagcttccttcccgttctctctgatttatgatgattcaaacttaaagatttttctttagttatattcttaagttctcataacaaatagaatgtaaatactattttctatcacttgttccataattatagaagaaacataaattatatgctatttaaattgtggtgttgttcaacattctataggtatacatacctatagaatataagaatatatatatatttgtacattcgtctatgcacctattttttatgtcaataatatgtctcatctgatacatgaattctaactatggtaagaatgcatgccatcgcatacaaacaaaatgccacaaaactaaacaaaatgttttatatctggagataatttgctacatttcagatttttttatgctacagtcatatttcttgtctctcttttccaaaacacaatcattgctgatgtgtgcaccctaaactgacagcttgagcttaacttggtatagttgtagataagttcagtttaaattaatgctgataaaacctccagaattgctgaagagaccatactatgttagtagaagtagagaaagtgaaatgagcttcttgtcctgttagctgacttgagttccattaaagattttaagtggagaaataaaatgaccagatgaaaggtcattaatttatacacaggaaaatagattataaagatgagaggtcaggatcaggaaactagttacggttgctgtaatctcagaagaatttggttgagagacgatgatatcaaaggttattgccagggtttttttatgcctgttgtgtttatttgtttgtttgttttgacagaaaaaaattgagtgaaagggaataccacaattgcagaagttcagttattattgagagaggtaatgagaatgattgacatgaatttcccccaaaaaatgttctgtcaataattactatattacgaataaatagagcatggaatatttttacagctgactcagagaaaatagctattacagcaaacctatgtctatattgaaattcatatatacattcaaagaatattactctataccatttatctcaagagaactaatcttcaaagcaaaagaaatcagcaacatgtttttaattaaaattttaacttccttcaaaaatgtcttttgggccaggcgcggtggctcacgcctgtaatcccgacactttgggaggctgaggagggcggatcacgaggtcaggagattgagacgatcctggctaacacggtgaaaccccgtctctactaaaaaatatacaaaaaaaattagctgggcatggtggcgggtgcctgtagtcccagctactcgggaggctaaggctggagcattgcgtgaatccaggaggcagagcttgcagtgagcggagatcgagccactgcactccagcctgggcaactgagcaagactctgtctcaaaaaaaaaaaaaaaaaaaagtcttttttatttatctgttaagaacagataaatcattcatgcggcattcaagtcaaaaaagaattttttgttgttggcagatttacctagtggaaacaacatttgtatttagcttctaaagtaaattaagtggaggaaaatgaagattttcattaataaccttaatattaatagacaatggtggtactgaggagaacatctatctcttttaggcttcatgaggaaatgatgtttttcagtgtcgacaaattaatttcagctgtgtggtttgcccaccaaatatcatgcctgtaataatatactgtacttagcctaccatattttaaaatgattggtttccaactatcaaggcatagaagagaatatatagatagttgaagagttaaagaaattatagcataagaagcatgcaaaaagatacagttatagcattataatgactgtcttgagatatttgaaaacatttatgaaggggagcaagttaacttttgatgaggactgtcacagtcagtgaagcaggtaacagtattatccaacatcgaatcagaggtcaagtgattttctaaaagtgtgacctatacggatattgccatatgtcgggggtgggggtagaagagttgatctcttctgagccctccacgttttaagttgtatgattcaaaattatacatacaaaccttgtttttattacactctattttaaaaactgcagttatcttttgagttgattttataatttatttttgttttaattgctaatgagctcagaagcagttccttggaaaatatatttcactacacaattcagatatcttcacttgtaagcactgttaagaaaaatatgttagacagaagttaatgaggttaaagagtcaccactttctttctccaggctgcgtagatgacatctatgaaatgcgtttgccttgcagttccctgtcaaatttcttctatgtggagccgcctccctcagctcaaaacacacatttcagctctcctgctctctcctacaggaacactgctgttctgtgtaaagaggaggtagggccttgtctttcacgcaagcctggctcaattgggcacctcaccactggggttgcagccaccgctaatccccctagaatgtctgtcctctggtgtgtctgcaccagtctcctttgcgagtgaccacagctatgtccacagaattgggtgcaggggagatgtccccctctctacatctgtgcccaagcactggggccacctgtctcctaggatggatctatactcccttgcaaggcaagcacggtgcctgtgtgcctgctgaaagtggtctagtcactttcagcccacaagcaggtttctcttgcacacaggaaagtggaatgaacaaaattaggaatcaacaaaaaaagtttatcataatcttaactatttggatattaagaaatattcctagtctatttctgcggtttaataaacactggaaatcttggctcagtgacttgtttgaggcgtgaattagctgtgttatttttctgtgcggtattatcaaagaaaaatttttgtgttcctcaatatgtttatattgtccagtaattagaaaagagcctagtgaatttatttgttttctatttttatttttattttttgagatggagcctcactctgtcacccagactggagtggaatggcgcaatctcaattcactgcaaactctgcctcctgggttcaagcgattctcctgcctctgcctcctaagtagctggaattacaagggcgcaccaccaggcccagctaattttttttgtatttttagtagaaacgggtttcatcatgttggccaggctggtctcgaagtcctgacctcaagtgatctgcctgcctcaacctcccaaagagctgggattataggcatgagccaccgtgcgcagcccatgaatttaatccaaaacaataaaaaccttaaatccctcaaaatactacctccttacattgaatttttctgagaagaaaatacagggctctgtttactgatgacagtagaaaagaaaaaaaaaaggaatacctgagctaagtgataaaattgacatatttctcaaccaaaaagctcatttaattagccagaggtagggtatatgtactcaaggggaatacattaaataggtttgtacatttttccttctagagagccttcctacaaatttatgcatcacgtgatccacaagacataatctcatcttcattagcaaagaccttctcgtcacatatcttagtcatctgagttctatcatttgttttgacctagaaaccctaatggaatgtgtaattattctaagaagagaatataattcagtgataaaaaaatttatctctaatatgattatttattacagtaaaaagtattcatacttttttttgttttttattgcaagtgaaatcttgtgattttccagacattaaacatggaggtctatattatgaaagtatgtgtagaccatactttccagtagctgtaggaaaatcttactcctattactgtgatgaatcttttgagactccttcaggaagttactaggattacatttattgcacacaagatgggtggtcgccagcagtaccatgtctcagtaagtaaacctctggacagccatatatgtataaaactttcaaagattgaagagaggagagcacataagtgattacacttgacttatataacagaaatagggccaagaaaagagttgttcaagcaaaatgaccaaaatagatcttttctattatgagttcttaaaaatcacgagaaataaatatagagactttatgagaatatctatataattgatacatattttaattataaaaacttaagtagtattaaatattgatatttctttttgtacaaacctttgttagtaattttagttcatattcagttatacattgtttttggatgtttatgcaatcttatttaaatattttaaaaataattgtaatatactattttgagcacatttttgtgtctcatttactttattcatttatcattgttatcgtccttaggaaaacgttattttccttatttggaaaatggacataatgaaaattacggaagaaagtttgtacagggtaactctgtagaagttgccttccttcctggctgtggtcttccaaatgagcagaccacagttacatgtatggagaatggctggtctcctccttgcagatgcatccgtgtcactaagtacactactctgagatcccagcaagttcatgtctttctaagtaacacagatgacatgctaagactcatctatattaactgcggcaaaatatttatgtcaacttgcttcgccatcggacctatttagttttattttttcaattctgtataaacaaatatacacatttcttgataagttcatagtaaaataaatgctcctattattgggcattagtcaagaatacagtaaaagagtttgaaaacaatacttgttggttaaattaagacatattgaaatggcatcattgtctggagtaaatacccgaggtttctcatctggcactgagaagattaaggacatggacacacacaaggagtgggcgtaggatcgcaggtttaataggcaaaagaaagagaaaggagaacagctctgtctcttgtgagagagaggggcacccaaaagtgaattctggccccggctggggtgcactggattttataaacaggcttgaggaagcagtgtctgatttacatagggcccaaagattgattggaccaggtgtgatatttacataatgtgctaggaagctggctgccccaccctaatcttattatgcaaatgggatctttgcctggccagcgccatgttgccttttccttactgtacacgtggctggcaaagagaagggaagatggagttgccatatgaacatgcctagtcccaggtagccttttcctattggcacaactgctgccattcaccttgcaagcttccaacttgcttgtctatgtttacatctctgttttacaggttccactttgttagaaaaagaaatgatttgggggctcctattattaaaaggaaaactttaccaaggactcctgtaccctcattatctgcctaaataatttcttcttaactcgtgtatcaatattaatatgtactttggaatcaatcatttgactcaaaatgattatacatttatagtttaaaatagaaagtgagtacaat

SEQ ID NO: 216 - DNA, 87650 bp, Homo sapiens
aacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacg

SEQ ID NO: 217 - DNA, 119406 bp, Homo sapiens
gacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacgggatttttaagaaccatcatcaatttcaaaacccgtgtcctcttagtgttactccaaagaatgttgaatatgaaataagaaactttctttgtcatagttttctatgtttagcatgtattcattcggaaagatatttcttaatcctgatctaccataagcagcaatatttgttaatgttttatgtgttccttcagtaaggagaaaagaacttaaatatattactttcagtttaaaggattaaaatttcttccaggactcatttcttttaccagaaatcacaaaactgttgatattatataaagtgctgtgtttgtatttgccttatttgaacttgtattttgatttgctctcacaataaatcaagtgatgaaatgatgttttttagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatcagtgtgatgagtctgatattttgctgttggtaacaaaataatcacagattattgaacaaccattctgctgaatgcctgcctaccaaaaatttcttttagaaagtaaagtttagaaattttctctttagggctgggtgtggtggctcacacctgtaatcccagcactttgggaggccgaggcgggcagatcacgaggtcaggagattgagaccatcctggctaacatggtgaaaccccgtctctactaaaaatacagaataataataataaccggcatggtgacgggcacctgtagtcccagctagtcgggagtctgaggcaggaaaatggcgggaacccgggaggcggagcttgcagtgagccgagttcgcgccactgcactccagcctgggcgacagagcgagactccgtctcaataaaaacaacacaaaaaagtaatttttctctttatatttatattttattttaaagaatttagttgataaataaaaatatactttcatgtttgacaatatgctgttttgatatatttatgctacaatgattaccacaaattaattagcacattcttcatcacctatgcttagcattgggtgtaggtgggtgtgtgagtatgtgtgtgtgtgtttgtggtgaggacacttaaaatctgctttcttgccaattttcagataaacaatacaatattattagctctaaatatcactagatctctatgtttgattccaagttcttattcatattatagctgaaagtttgtactctttgaccaatatcttaatcaaacaaaagcagcaatgataagttctaaaatgcagggatcctaaaatgacaactgatgtaatgaatcattgataatacacccctaattctcatacattaaacataaaacctcattttcacatcgattaccattttaagtttatttaaatcaatatgatgtttttacatagtcggtttggacagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaactgttgtgtccagttcataaaatgtttgtggcaagaaattagatgcaatttttcagactttatttctgttcatcactcttaaatctctcaaagctttctccacagcttctgaggctcattgttttacagtaaacggaaaacatatcattgtctctgatttcaaaattatatcactttacaaagatgtaaaaaccaagtcaagtcttaattcatgttggtaatgagatataagtaattacaatttatcaatacataaatgcaccaaaaatgatatcaatacattaatgcaccagaactgatgaaatgtagatacttctacaagatgacaatctagcacacatgataatgcaaactaatcataagaattaaaacgtaattgggtatataaatattacaacataaacatacaaaaaataaaaatacagtatcagttataacatgctcacttgcatgcactcacttgcaaacatagaaacatgatacttttgccctgatttaatgtttatagaaaaaatattgccaggaaattcaaaactatagttaaatgtgtgtgtatatatatatatttatatgtatgtgtatgtgtgtgtgtgtatgcgtgtgcgtgtgtgtgtgtgtgtttagagatagtcggggtaaaagttagggtttaattcttttgtatatatcggtatcctctgatttttctacctttaacatatatcactttggaaacaaaagtacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttaccatataaaatcaggtggcttatatactcaggctgtctccttgttagtgatcctgatttagataaattgcttgagttgaggaaagccagatttcaaaaatctaaaggacatttgttataattagcaacttatgttgatagaaatgttaacacttaggaatatatgtttattcctaaattgttttagtacatttgggccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttactttctgatattatcaccatagtgatgaggatgtaacatacaaattttgaaagggtactactatgcacaccatagcacagcatagggataaacaaatatgttccatgtaaatggaaaccaaaagcaagcaggggggctatactaacattaactaaaattgaatttcaagtcaaatctgtaaaaagaaacaaggaaggccattatacagtaataaaggagtcaattcacaaatagattataactattgcaaatatatatgcactcaacatgggagcaatgaaacttataaagcaagcattaatacatctaaaggaagaaataaacaatgcagtaatagtaggggacttcaataacccacattcaacaatggatagacagtctatacagaaatcaataaaaacattggacttgagctctatgttagaccaaatggacctatcagacctatatagaacattccatttgacaacagtagaataaacattcttctcaagcacacaaggtataatctccaatatagatcatatgttgggccacaaaacaagtcttaaaaaattttaaaaagattgaaattacataaatttttttaacattgtcatatgaaattagaaaacaatagcagaagaaatgttaggaaattcacaaatacatggaaattaaacaacatgatcctgaacaaccaatggggcaatgaagaaattcaaagggaaatttaaaaatatcttgagaaaaacaaaaatggaaaagcaacatactaaaaaacatatggtatgcaacaaaagcagtataaagggatgtctagagatatgaatgactccatgaagatcctaataaagcaagtaactttgtatctcaggaaactagaaaatgaagaaaaaaattaacccaaagctactggaaagaaaaaaatagtaaggtacagaacagaagtaaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaacagaagagaccgctataaacagttatatgccaacatataactgttggataacctaatagaaacagatacattcatagacatctacaacctaccatgattactgaaacataatgaaatacaaaattaatacagaacagtaatgagtaagaaaaatgaacaagtaataaaaagtctctcatcaaaaacaaaacaaaacaaaaaaaaaactcgtggcttcatgacagatggaatcctaccaaacatttaaagaatcaatcctaatccttcccaaattctgtcaaaaatttaagagtgaactctcagttttattatatgagggcaaaaatcgtactgacaccaaagccacacatggatactaaaaaaaacaattagaggtcaatattcttcatgaatatagaggtaaaaatgctcaacaaaatacctccaaagtgaacacaacacattaaaagaatcactcgccataatgaaaggggatgtatatctgggatgtaaagatagtatacatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaagctcacatttaacattatactcaagagtgaaaagttgaaacatttttgtctatgatcagaaaaaaaaaaaaaaaacaaggaggctcactctcaccacttctgttcaacatagtgctggaaatcctggctagagctattaggcatggaaattggaaaagaagacagttgtctctgtttgcagatgacatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtacactgaaaactataaaatattgatgaaagaattgaagaaaacacaaataaatgaaaagatgtcctgtcttcaaggatcaaaagaatcaatattataaaattgtcttcaatacctaaaactccagattccatgcaatattgtcaatattctaaacacatctttcacagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctgggactatatccatgttaagcagtctttttcacataattaactgaaacaatgggtaccctttgtaagattttttaaaattaggcaaaataaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcacaaactgttgccatgatgttttctcctgactggcctgcttttgctttcatcggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcgtctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgtatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagctgactctgagtgcgaatcttcttttcaaaaatgatttaaatacttcttatctctggttcaccctattaccgaatccatagagttgtatattaattttcacttgttttcttcattcttagattttgcttttttcattcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatgggtaaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcaagatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccgctgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaatcatcaagtgttatcaaacatgtggagaaaaggacacacttgcacattgttgatggaaatgtatattagtatagccattatggaagatactatagagtttgtcaaaaatgaaaagcagaacatataatcaatccagtaatcctactactgaatatatgtacaaagaaaaaggaatcagtatgtcaaagagttatctgcattcccatgttcattacagcattatttataatagccaaaatgtggaatcaacttaagtatccattacagatgaatagataaagaaaatgtggtctatatacacaacgtaatactattcagctttgaaaaaaggaaatcctgcattttcaagaacatagaataaacagggaggacattaagttaggtggaataagacagacaaaaccacatgattgcacttatacgtgcaatccgttgtaaaatatggtgactttagttaacaataatatgttgtattcttgaaaactacttagtgtagattttaagcagtctcaccacacacaaaaatgagaagtatgtgaagtaaagcatatatttattagcttaatttagccattatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaaaaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataatagtgataatattatatatttcaatattgctgagtacatatattctatttaatatatttaagcctagcctttctaactactacagaaagagaagctaaatgtctgttgtaagtatgcttatcttacaaaaaataagttcatttgatattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaatatttatttctcctttttatagaatttcaaaatcaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcatgtgcacatcataggtgtacagtaggtgtatgtattgatggagtacttagaatgttttgatacaggcatacaatgtgaaataagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctatttttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaattccacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagatatcgcttccatacactgatttccatacactgctgatgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaactgttaattgcagagactcttttccacagcgttcctttgtcaaaaatgcattcactgtagatgtgtaaatttgtttctgtgttttctattctgttccattagactgtatgtctgtttttatgccagtactatcctgttttagttactacaactctgtagtataatttgaagtcaggtaatgttattccttcagttttgtttttattgcttaggatagctttagctatttttggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatctttttttttttggtgtcctcttctacttctatttttagtgttttactctttttcttatagagatctttgacttctttggttaatatctaattatttatttttatctgtggttactgtaaatgggattacctttaggatttttttcagattgtttgctgtcaacatatacaagtgctactggttttttatgttgatattatatcttgcacccttactggacttatcagttctaatagttttctggtgattaccttacgtttatcgaaaaaaacttataccatctgcaaacaaagataatttggcttctttcgtttcaatttggatacctttatatccctctcttgtctaactgctgtagccaggacttccagtattatgttgaataacagtggtgaagtgggtatccttgtcatgttccagtactttgaggaaattatttcagactttctccattcagtatgatagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtgtatgttgagccatctttgcatctcaaggataaatcccatttggtcatgttgaatgatctttctagtatgctgttaaatttgttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaacgttagggagaattcaacagtgaagccaatatgtcctgagcttttctttactatgaaactttttattctggctttgatctcattacttgaattaataattgatctgttcaggttttggatttctttctgcttcaatcttagtaggttttatgtgtctaggaatttgtccatttcttctagattttccaatttattggaatatcattccacatagtggctaataatgattctttgaatttctccaggatcagatgtaatgtttccttttcatttctgattttatttatttgaattctcactctttttctcttagtctggataaaggttgatcagcatgtttagtattttaaaataagaacttatgtttcattgatctttgtattttattcatttcaatttcaagtttatctgctgtgatatttattatttattttcttctaataattttggatttggattgcccttccttttctagttcattaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccacagtgcattcaggggcatattctttaatttccagattctttaattttttgtttcaacttaccatatggattgcaaatactatcttaaaaccagaaaacataacactgtttgcataaacaaacaagccaaagtaaactcataaatactttccaccttaattttcccttctgctttcaaactttttgttgtttctatttttatcttattttacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattatttattgttcatgaatttcgttttttgattgaaatattccctttagcatttcttgtaggacaggtctggcataataaaattcctcaccttttccttatctgagaatgtctttatttcttctttatgtttaagggatattttcaccagatattctactctaggataaacgtcatttttctgtcagcatgtgtcatatcactcctgtaaggattcctctaaaaagcctgctaccagatgtattggtgctccgttgtatgttatttatttctttgttcttactgattttagaatagtctctttatccttgaccttagagaatttgattattaaatgagttgaggtagtcttctttgggttaaatctgcttggcattctataaccttcttgtacttgatatagatctcattctctaggtttgggaagttctttgtgattatccatttgaataaactttctactcctatctcgttctctacttcttccttaaggtgaatactctcagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacatgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccagcaatgcagtggttcttgcagacttctaggggtactgtattgatggtcttgcacatgatctgagagaattcagggtgatgagggcccctggaccagggtggtttccaggggaccagtttcaaaaaccttagatgtctgcttgatgttatatggtactgtatctgggctggcagtcatattgcaagttaaaatgttgtggggtggggtggggggatgggggagggatagcatttggagatatacctaatgttaaatgacgagttactgggttcagcacaccaacatggcacatgtatacataggtaactaacctgcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccacggtatgtccaaaaatgccacccaccagtcaagtccaggaactggggaccctgggagcccaggtggttctctacccactgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcacgctcttggctgcctcagctggtgcagttggtgtctctgaatattctgtgtcttcccccagtccatagtctctgagcctagttcagcactaggactcacatacgtgtgcagtccttatgtcctagactgtctttctagtttatttagagacacaatgcatggtaggtagccctaggtggcaagatttgtgggaacttgatttcagacccctgcggtcagcaataccatcatggctagcattggtttaagtactccctccatgggaaggggttagctgagtttggtttggttttcctttctgctctaacagcacagcattttgttcaatgcctcacaattgctatgttctccctccctcagtgcctagagcaaggctctgtacaccatggcacagctgcaagtgtggggagaggggaaagggtagtgtcagtgattcaagattgtctgacctatctcttacgtgccactttcagggatatgaagttaaaaccatgtactatgagtgctaatctgataatgttttcattttatgaaggtgttttttttttttttttctgtgtacatagttgttaacttagtatctttgaaggggaatggttggtgtctcctattccaccatctggctctgctctgcctaatttgtggaaactctttatcatgaagaaatgtcaaagtttctcaaatgtttttagtacttctatgaaaatgatcatatagttttgttcattctgttattgtgatatgttacatctattggtttgtgtatgtctacccatctttattttatgcatagtttgaaaaacagtactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaagacaaggcattatctggtagcagctgctggtagcagctgagatcaccaacagtagctttccttgcttctggaagttttcctaaaaaacatccactgcagtacaatggataattagtggggcatcactaagattcctgaacttcggaattttctggaaatagcatttttgacctttgttccctcagttcttccaatagttgtggaagcctttcgttccctttattgatactctctttactcaaaaaatgagaaataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaacaatgaaagatttcaaactccaaacagtacaactgaaacttttgcattactatactactgagaatatctaacatgttgttactaattaatgtcattctcaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcattatgctagtagaaatagcatattttgtaagactataacagaaattaattttatgaaatattatctcattttaacttaaacaatgaataatattctctttgtttcataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatataccaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataaataattattttttatagctttatgttattgttcactgatttgttttctcctcaacagtcatatattttctatattaactatctttttgaatgcaggccttgcatattaaagaactatatcgtaacattagcagtggaaccacatgagtcaaaaatcatggacaatcaagggtttgtggccattaatgaagaatataaattttgtaattatccgaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacgatttgctagttttatttgttgtgcaaaatcaaacttgatctgtgccaaaatggaaagaaaaggaaattctcctgttatttcctttgttaactgaactgatacaggtacatttttttcaaataaagattaaatagattaaaatagaatgaaaagaagaaaagtagtaccattttgaaatgactggaattagagaagcatatgcactatactttcttacttactttcttaaaagcactataaaaaaagaatgatgacaaattcttccttatctgatattccagttgaaaacttttctcctccaatgaactttttgtaagagtaaacttgagcaaaatgtcttgtaaatttaggtcgcacctatatttctcaaaggagaaagtaactcattgggttaccttcaacgtcttggttagagagaaacatctttgtgtattcagtagcattggctcaactgcatcccgccaaaattcatttgttaaagtccaaattcccaatacctgagaatgtgactgcatttggagaaggagtgcttaaagatgtaattaagttaaaggtcaatggttcaggtgggtcctactccaatataactggtgtctatataagaagagaaaataagaacacaccatatagagaaagatcacgcaaggcatagaaaggatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataactttttactttttactcaagagtatatatatatatatgtagccaccacacagattttagaggctattcatcagaatttggtaattatatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacattaaaatcggcacaccaattcttttggaaaccacactatttgaaagacaaactcgacagaaaatttgtaattgtaacctattataatgttcattgaatttgtattggccattatttcttccattaagtcataagttatttatacttatttaaagataggttgtcaagagcattatttttaattatgaatatcctttcagaattgtataaactttatattcatctactagagttgccataacaaagtgtcaagggtgacaattagtaatgtagagcagggttgcttctaaatcccttttaaactgatcattttcagtacccaatgcattacagttaattgccattgtacttctttgggatgctcaaatttgtttcaaatctcactaagaagctggcttttgtgtatatttcatgtgcccccattaagctttggcataacaaaaggtcccatgctttccttgacttttgctactacagactaactttcaataatttctgtatgaaattccagtgccttttagtgggaaaaacgatttttagaaacaaacctaaactatgaaaaactcacttcaggtttgaaattatcgttgactaagaaaaataatatttggccgagtggggtggctcacaccttcatcccagcactttggagggccaaggcgcgcagatcacttgagaccgggagttggagaccaacctggccaacatgatgaaatgctttctctactaaaaattcaaaaaattagcaggatgtagtggcacacacctgtaattccagcttctcaggagactgaggcaggagtatcatttgaacccaggaagcagaggttgaagtgagctgagatcgcgccactgcactctagccttggcaacagagcaagactgttaaaaataaaaataaagaaagatttaaatgatttcctttaattaatgtccctttcttcctcggactaaatatcctgcaatcataagaaaatgtaaaagtatctcaggaggttacacagggcacggaagtttcgattttccaatacggaggagacagcagaaaactgtgcagccatgcttgaggggctgggtcagacaagctgtcatgcgtcacctaacaagcctctagggccagttctgtaactagcaaacgcttccctcaaagtaaagatgtcacgtctatgaacttagtcttctcatctgcacactaaagctgttgtgccactagcttccttcccgttctctctgatttatgatgattcaaacttaaagatttttctttagttatattcttaagttctcataacaaatagaatgtaaatactattttctatcacttgttccataattatagaagaaacataaattatatgctatttaaattgtggtgttgttcaacattctataggtatacatacctatagaatataagaatatatatatatttgtacattcgtctatgcacctattttttatgtcaataatatgtctcatctgatacatgaattctaactatggtaagaatgcatgccatcgcatacaaacaaaatgccacaaaactaaacaaaatgttttatatctggagataatttgctacatttcagatttttttatgctacagtcatatttcttgtctctcttttccaaaacacaatcattgctgatgtgtgcaccctaaactgacagcttgagcttaacttggtatagttgtagataagttcagtttaaattaatgctgataaaacctccagaattgctgaagagaccatactatgttagtagaagtagagaaagtgaaatgagcttcttgtcctgttagctgacttgagttccattaaagattttaagtggagaaataaaatgaccagatgaaaggtcattaatttatacacaggaaaatagattataaagatgagaggtcaggatcaggaaactagttacggttgctgtaatctcagaagaatttggttgagagacgatgatatcaaaggttattgccagggtttttttatgcctgttgtgtttatttgtttgtttgttttgacagaaaaaaattgagtgaaagggaataccacaattgcagaagttcagttattattgagagaggtaatgagaatgattgacatgaatttcccccaaaaaatgttctgtcaataattactatattacgaataaatagagcatggaatatttttacagctgactcagagaaaatagctattacagcaaacctatgtctatattgaaattcatatatacattcaaagaatattactctataccatttatctcaagagaactaatcttcaaagcaaaagaaatcagcaacatgtttttaattaaaattttaacttccttcaaaaatgtcttttgggccaggcgcggtggctcacgcctgtaatcccgacactttgggaggctgaggagggcggatcacgaggtcaggagattgagacgatcctggctaacacggtgaaaccccgtctctactaaaaaatatacaaaaaaaattagctgggcatggtggcgggtgcctgtagtcccagctactcgggaggctaaggctggagcattgcgtgaatccaggaggcagagcttgcagtgagcggagatcgagccactgcactccagcctgggcaactgagcaagactctgtctcaaaaaaaaaaaaaaaaaaaagtcttttttatttatctgttaagaacagataaatcattcatgcggcattcaagtcaaaaaagaattttttgttgttggcagatttacctagtggaaacaacatttgtatttagcttctaaagtaaattaagtggaggaaaatgaagattttcattaataaccttaatattaatagacaatggtggtactgaggagaacatctatctcttttaggcttcatgaggaaatgatgtttttcagtgtcgacaaattaatttcagctgtgtggtttgcccaccaaatatcatgcctgtaataatatactgtacttagcctaccatattttaaaatgattggtttccaactatcaaggcatagaagagaatatatagatagttgaagagttaaagaaattatagcataagaagcatgcaaaaagatacagttatagcattataatgactgtcttgagatatttgaaaacatttatgaaggggagcaagttaacttttgatgaggactgtcacagtcagtgaagcaggtaacagtattatccaacatcgaatcagaggtcaagtgattttctaaaagtgtgacctatacggatattgccatatgtcgggggtgggggtagaagagttgatctcttctgagccctccacgttttaagttgtatgattcaaaattatacatacaaaccttgtttttattacactctattttaaaaactgcagttatcttttgagttgattttataatttatttttgttttaattgctaatgagctcagaagcagttccttggaaaatatatttcactacacaattcagatatcttcacttgtaagcactgttaagaaaaatatgttagacagaagttaatgaggttaaagagtcaccactttctttctccaggctgcgtagatgacatctatgaaatgcgtttgccttgcagttccctgtcaaatttcttctatgtggagccgcctccctcagctcaaaacacacatttcagctctcctgctctctcctacaggaacactgctgttctgtgtaaagaggaggtagggccttgtctttcacgcaagcctggctcaattgggcacctcaccactggggttgcagccaccgctaatccccctagaatgtctgtcctctggtgtgtctgcaccagtctcctttgcgagtgaccacagctatgtccacagaattgggtgcaggggagatgtccccctctctacatctgtgcccaagcactggggccacctgtctcctaggatggatctatactcccttgcaaggcaagcacggtgcctgtgtgcctgctgaaagtggtctagtcactttcagcccacaagcaggtttctcttgcacacaggaaagtggaatgaacaaaattaggaatcaacaaaaaaagtttatcataatcttaactatttggatattaagaaatattcctagtctatttctgcggtttaataaacactggaaatcttggctcagtgacttgtttgaggcgtgaattagctgtgttatttttctgtgcggtattatcaaagaaaaatttttgtgttcctcaatatgtttatattgtccagtaattagaaaagagcctagtgaatttatttgttttctatttttatttttattttttgagatggagcctcactctgtcacccagactggagtggaatggcgcaatctcaattcactgcaaactctgcctcctgggttcaagcgattctcctgcctctgcctcctaagtagctggaattacaagggcgcaccaccaggcccagctaattttttttgtatttttagtagaaacgggtttcatcatgttggccaggctggtctcgaagtcctgacctcaagtgatctgcctgcctcaacctcccaaagagctgggattataggcatgagccaccgtgcgcagcccatgaatttaatccaaaacaataaaaaccttaaatccctcaaaatactacctccttacattgaatttttctgagaagaaaatacagggctctgtttactgatgacagtagaaaagaaaaaaaaaaggaatacctgagctaagtgataaaattgacatatttctcaaccaaaaagctcatttaattagccagaggtagggtatatgtactcaaggggaatacattaaataggtttgtacatttttccttctagagagccttcctacaaatttatgcatcacgtgatccacaagacataatctcatcttcattagcaaagaccttctcgtcacatatcttagtcatctgagttctatcatttgttttgacctagaaaccctaatggaatgtgtaattattctaagaagagaatataattcagtgataaaaaaatttatctctaatatgattatttattacagtaaaaagtattcatacttttttttgttttttattgcaagtgaaatcttgtgattttccagacattaaacatggaggtctatattatgaaagtatgtgtagaccatactttccagtagctgtaggaaaatcttactcctattactgtgatgaatcttttgagactccttcaggaagttactaggattacatttattgcacacaagatgggtggtcgccagcagtaccatgtctcagtaagtaaacctctggacagccatatatgtataaaactttcaaagattgaagagaggagagcacataagtgattacacttgacttatataacagaaatagggccaagaaaagagttgttcaagcaaaatgaccaaaatagatcttttctattatgagttcttaaaaatcacgagaaataaatatagagactttatgagaatatctatataattgatacatattttaattataaaaacttaagtagtattaaatattgatatttctttttgtacaaacctttgttagtaattttagttcatattcagttatacattgtttttggatgtttatgcaatcttatttaaatattttaaaaataattgtaatatactattttgagcacatttttgtgtctcatttactttattcatttatcattgttatcgtccttaggaaaacgttattttccttatttggaaaatggacataatgaaaattacggaagaaagtttgtacagggtaactctgtagaagttgccttccttcctggctgtggtcttccaaatgagcagaccacagttacatgtatggagaatggctggtctcctccttgcagatgcatccgtgtcactaagtacactactctgagatcccagcaagttcatgtctttctaagtaacacagatgacatgctaagactcatctatattaactgcggcaaaatatttatgtcaacttgcttcgccatcggacctatttagttttattttttcaattctgtataaacaaatatacacatttcttgataagttcatagtaaaataaatgctcctattattgggcattagtcaagaatacagtaaaagagtttgaaaacaatacttgttggttaaattaagacatattgaaatggcatcattgtctggagtaaatacccgaggtttctcatctggcactgagaagattaaggacatggacacacacaaggagtgggcgtaggatcgcaggtttaataggcaaaagaaagagaaaggagaacagctctgtctcttgtgagagagaggggcacccaaaagtgaattctggccccggctggggtgcactggattttataaacaggcttgaggaagcagtgtctgatttacatagggcccaaagattgattggaccaggtgtgatatttacataatgtgctaggaagctggctgccccaccctaatcttattatgcaaatgggatctttgcctggccagcgccatgttgccttttccttactgtacacgtggctggcaaagagaagggaagatggagttgccatatgaacatgcctagtcccaggtagccttttcctattggcacaactgctgccattcaccttgcaagcttccaacttgcttgtctatgtttacatctctgttttacaggttccactttgttagaaaaagaaatgatttgggggctcctattattaaaaggaaaactttaccaaggactcctgtaccctcattatctgcctaaataatttcttcttaactcgtgtatcaatattaatatgtactttggaatcaatcatttgactcaaaatgattatacatttatagtttaaaatagaaagtgagtacaatgatagccaataatgtcattcatacattcaaacagtcataggtcacttttacaataaagttatctaactttctctattatatgtaagtacaaatggattttctgggatattgtgcatattcgactctagaaggtttcctatattatttatcccaatatacatttatatcaacagttccttcttaggtgttttacatgttaatgattggtgatgtcacattttaatatttacaaattgagtggctataaaatgttttaccattgtagtgtaaatttgcatttcctttattactaattgggtttggaatatatattcacagtttaattggtatttgattgttctaatctttgaaaatgcaggttttttgacttacctttttgggagttttggtatttattagttggagtcatcttactaattctgaatataaaatctcttttaattatatgtaatccaaatgcattcttttttgtggctagtatttttcttcccttttttgtgtattatgaatataagttgctcgttttactaaataatcatcaatcttttcttatgatgaatattttttgtttctatttaaaggaatacttcaaaaacacagagccattatactatttttattgtaaaaatttacatgctaccttttttcatattttaaaattgtgtgttgattttattcatgataatagctatattttatttttaaataaaatatggcaaactcaacatttccctaacaatttttatagtacctttctcatacagtatatgctatattgtatattttgtcccctcccctcccctcccatcttctttttctctttcacagtgtgtcccctcccctccccttccctcttctttttctttctttctttctttctttctttctttctttctttctttctttctttctttctctttctttctttctttctttctttccttccttccttcctttctttccttccttctttccttccttctctctttctttccttctttttctttctttctttctcttcctctctctttttttttctttcttcctttttgttctcttttttctcttcctttctttcctttctttctctttcttttgttttttctctttctttctttctgctgttaagagtgaactacttttttcccctttcctttcctttccgttcttttctttctttctctttcttctttctttctttctttttttcctttctttccttctttctttctttctttctccttccttcctttcttttttctttcttctggctaataatatgctttgattgaatatgcaatttctcctggtatcaaacaactcaatcaaggtttatgcctcttgttttggatttggagttgtttgaagaatcaactacttattttctttctttctttttctttctttctttctttcttttcctttctttcctttcttttctttctttctgtctttctttctgtctttccttccttccttcattcctttctttcttttttttcttttctttccattttcttcctttcttccttcctttcctttctttatttctttcactatcccaagtgtgcctggctcaagttattcttgagaatgttactgttttactcttcatgctagaccctgtactttagtcaagttatttagctactttatggtggtcatataattaacaagtcttagcttcatcttcagattgcgatatcaacattgtattttcaatgtacagtcaattgtcagtgaatcacagtacttttcaatttaacaaaatctaaattcctcataaccatgttgtgaaaataagcagaaaaatttaaatatacttgtgcgagtacagtagacagatattggagtgtgtcctgcatgagtgcaaactggctgtggtttcctttaaaatagtcacttaaagaaaacatttgccaaatacatcacagaatatcaatttttctggacttgtaaaac

SEQ ID NO: 218 - DNA, 88155 bp, Homo sapiens
gacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacg

SEQ ID NO: 219 - DNA, 68715 bp, Homo sapiens
aacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaa

SEQ ID NO: 220 - DNA, 94244 bp, Homo sapiens
atccaaacgtctccctgaattgataacaaaatgtcagacacttaaaatcattgccatgatttcctatagtacgattacataaagctttaggtgaagtagagcatacactatgataggagaaaggaaaatcaagggattatagaatgctcccagatgcttctaaactcccccgtcagtcaaacaggacatgcttcattttcatattatgaaaaaatgagatatttctgatgtatcgcagtttaacaggagcttagctgtgagtttacaaaggtgtctttatatgtgattatacaactaaagccaggctgtgcaatgcattaaactgggtgcataacatccatttaaatatccctaaacagtacaggtaagctagtaaataaaagctctaggggagtttcaagttttaaatagcacactataaatcactagtgattatatttaatgcttatattggtcaagtgtcagtaccaaattgattattaactacatataattctacttctggctaatcagattccattggcagaaaatttgtgagtgttttaatccaatcctgatacatttgattatagatatcaatttttatttaatgcatgtaattaagagtgtgtaattccattaaaacattctaaaggctcaaaataattaaaatcaatattacataaattatgcaaatttattaaacaaagaatatatgaaaaaactacaagaaagtctatgagaatacaagccaaaagttctattgtttaatgtaactgttacacagctgaaaagtataatatttgcatacaaaaacatcataattaatatgtgataatttatgaaacagttattgatctttctatttattctattttaatcatataaattatttttcatcaaaaattctaattttaatatttttattttttattttttattataacattaattatatttttaatattttttagtggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttggtcagtagtgtataatttgttttacataattctttcaaatgaggttaatattctcttgtgcttcgtgtaaacaagagagaagttctttctctgtgtctattactttatcctgacaaaataaattaggacctaggcacattaatcaatcaccactctttcagttttttgaacaaaatacagccaaaatctttggaatattatgtaaatgtcagataacatttccattcatgcatattttaatccttgtgatgaacaagacatgaatgaagatgattattgaacaagaggatggtaacatagatatggtggaggaatatatctttgcgagtttctaatatgtttttgtttttaaataattttatttgttcaaattatactcactttaaaatccgaaatagtatttagttttatatttcaatttaagtattttatttgtttttaaccctttgattttcattcttcatttagaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggttaggccaatatgaatactcaatttctgtttatagtagaattcataaaaataatctcttgttatcaaagtgaggggaataattgagattactgcatatataaaataatttatatattataccattaaaatactttttgcatgattgaatctattctatttatgttaattttatttgttcatgatagagtcactttgtattctggcattaaaaaataatatctagtgaaattaaacctatctgtattattctcatgctgccataaagaactgcccaatactggataatttatacatacaaaaaaaggtttaattggctcactgttctgcatggctgaggaggtcttaggaaacttacaatcatggtggagggagaagcaaacgcatgaagacaggaaggagaagttctgaccaaagggaaaaggcccttataaaaccattagatctcatgaaaacacactcactatcctgagaacagaagcatggggataactgcccccattattcaactacttcctactgagtccctcccacaaaacatggagattatgggaagtacaattcaaattgttatttggttggagatacagtcaaatcctatcattccaccatggcctatcccaagtctatgtcctcacaattcaaaacacaatcatgccttcccaacagtcctccaaatcttaacttattccagcattaactcaaaagttcatatccaaagtctcatctgagacaaggcaagtcctctctgcttatgagcctgtaaaatcaaaagcaagttggttatttcctagacacaatgggggtacagggattgggtaaatgcttccattccaaaagggaggaaatggctgaaacaaagtggctatatgcttgatggaagtctgaaatttaatagggcagtcattaaaccttaaatttccaagattatctcctttgactccatgtctcacattcaggtcatgctgatgcaagagatgggctcccacagccttgtgcagatgtggctttgtccccctcctggttgctttcatgggctggcattgagtgtctgtggcttttccaggaacatagtgcaagctattgatggatctaccattctggggcttcaatgattgtggtcctgttctcacagctccacaaggcagtgcctcagtggggactctatgtgagggctctgaccccacatttcctttcctcaatggcctagcagaggttctccatgtgggctcccccctgcagcaaacttctgcctggacatccaggtattttcatatatcctctgcaacctagttgtaggttcccaaacctcaattcttgacttgtgtgcacccacaggcccaagactacatgtaatccaccaaggcttggggtttcaccctttgaggcaatggaccaagctgtttgttggccccttttagccacagctggagctgaagcagctgggatacagtcctgaggctgcatagagcagcagggacctgatccaggtccatcaaaccatttttccctcctgggcttctgggcctgtgatgggtgggggtgtcatgaaggcctctgacatgccccggagatatattccccattgtcttggtgattaactttggctccttattatttttgcaaatttctgcagcaggcttgaatttctccccagaaaaatgaagttttattttctattgcatttacaagctgcacattttccaaacttttatgctctgcttcctcttgagctctttgccacttagaagtttattctgccagataccctaaatcatctctctcaagttcaaagttccacagatctctaaggcagggcaatatgccaccagtctctttgcatagcaggagtgacctttactccagtttcaaacaagttcctcacctcatcttcatctgtgaccaccccatcctggacttcattgtccatatcactgtgagtattttggtcaaagccattcaacaagcctctaggaagtgccaaactttcccacatcttgtcttctgagccgtccaactccctaggaagttccaaacattttaacattctcctgtcttcttctgacccctccaaatggttctaacccctgcctgttatccagttccaaagctgcttccacatttttggttatctttacagcagcaccctactctctgcagtaccaatttactgtattagtctgttatcatgctgctataaagaactacccaagactgcataatttataaaggaaagaggtgtaattgactcacaattccacatggctgggaggcctcaggaaacttacaaccctggtggaagggtaagcaaacatgtccttcttcacatgatgacaggaaggagaagtgcaaagcaaagacagaaaagctccttataaaaccatcagatctcaggagaactcacgcagtatcatgagaacagcagcagaggaaaaatcgccctcatgattcaattttctcccaccaggtcccatccacaacacgtgaggattatggcaattgcaattcacgatgagatttgggtggggacacagctaaacctgttctgcaagttgtcatgtttgctttgccactatgttttaaaacttcttttacattcttcccacaatgccccttcttatttcctacaatatattatgttttacctggaatcgttaactctcaatgtgtatcttattatcactagtaagtttacagaggcattgtttaccaggcatagatgatctctttctgaaatgtattgctatttttagtttcaagtccttcttcagttggtgacagtccgatagacagacagacaccagaaggctagttttaggaaacatttgtgttacttctctgtgatgtcatagtagctcctgtattgtttattttcaaataaaactacttaatattaaaacaggcatataaaattaaatttatgagttagtgaaacctgaattcattcttttttttttaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattctcagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttataaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatctattataaagtttgagagaaataaatcttttttacaggttaaatataggttttgccacatacttttatctttattcatttgattttcagttccaattgtgtccaagtggatgttgaataacatagtttgcctacctatataaatcaaatgttctcaaagtgtggtcgctaaaccggtagcatcatcatctccttggagattgtttgaaatgaaaatacaattccataagctcattctagacacacggaatcaaaaatgtcgaaatagaaccctgaatctgttttaccaacccctccagggaattctatgcacacttctgtgtgagaagcattgctatagtctattatcactacacatggacctgaaactctctgatgaattttgcattgttcagcatagtatccttaatcattggcaattaaattatctgaagttatttttattattatagacttattttcttttatttttccacatctccaatttagatcctttgattaaccattcttcttctctactaacttgggtaattttcaaaatgtgtttttaaatctttgcttattcactaagaaaatgcctatttgtgtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaaagcttgtacctgacaaaaaatagtttcatgtcttttcttcaatattacatttaaatttattaaaatcaacaaaatatttgatgagattgtctacttattttaaattcgtcttgaaacatatttgtaactgtattagttgatttgctactcaaaatgaacactaggtggaaccacttcttttttttctactcagacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaaggtagagtattatatttcttttaacattttgggggagtatagcagggttaaaatatgttgatttaaacaaaatgaagtcatttttattaatagatttttcaaatgcaaataaaatgattgatggtgcttaaaattcaattcttcctgtgaacagaacacaagtaatagggtgtattatttttgagaaagattcgaccaaattaaaagagttggaacctgaaaaacaatactttttaagcatcacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaataaatagagatggagtaagggaaaccagaaaaggaaattgtatcttacttacctttatgttttaaaattaatgttgtcctgtgtttttttttttttttcactattttacttagactctacctatgtttattattgaagtgagtttttgtagacagcatatagttgggtcatgtttacatatccattcatcctttcatggcctgttaactggtgcacttggaccaattacacttaacataattattgatatataggacttaaacctctgtcatttatttgtttctgtctgttccctctgggtttcagtcctatttccctattcctccattccctgtagggaaaattattaaggagattaattttgattcatatgtattgttttccattgtatctctttgcatagcttttcttctccttttaaaaagttgttgctctagctaatactatatatatgtaataatatattactgtctactggcactgacatttaaatcaacaactggaatatggaaagcttactttcatgtagatccatttatactctccacattgtaagtataaatgccagtcgtattttctctgcatgcattgagcaccatattaaactcatttgcttcaaatatcaaacataattgaaaaaacttatgaggaaaaagatatcgtgttatattgactcctctttttatccattatatcgttctattttttcaggatcctgaagtctcaagctctttcttttatctgttttattttaatttgaagaattcctttagttatctttaggcataggtctactggagacaaattctcttggtttccctttctctgagaatgtctatatttacccctttacttgtaaaagatcgtgtcactggatatcaaatttggagttgacagttctttgaacacttgaaaactgtgccacatggttatagatgaaaaacttaccatcatttgaattgttgatcccctcaaggaaaagcatagtttttgtctagttgctttcaaggtatttttttctttttttaaagtagttttattttaatgtatattggtataaattccaatgtttttatcctctttggagttcactcagcttcttaaatataagtttatgccttattgtcaaaatgggaagttttcaggtatccttttatttattcatttttccagcccaatatcctttctcttctttttctgcatctgcattatttgttgttgtatttttctgaatgtctcagttcagttttttgttttcagtctattttcagagtgggtaatttatattgctgtatgttcaagttcatggatttatttgtctgtcagctccccatgtattattaagtatattcagtgtttttaaaaaatttttatcatacttttccattttataattcctacg

SEQ ID NO: 221 - DNA, 84576 bp, Homo sapiens
aacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaactaacggttgtgtccagttcataaaatgtttgtggcaagaaattagacgcaatttttcagactttatttctgttcatcactcttaaatctcccaaagctttctccacagcttctgaggctcactgttttacagaaaatggaaagcatatcattgtctctgatttcaaaattatatcactttacaaagatgtaaaaaccaagtcaagtcttaactcatgttggtaatgagatataagtaattactatttatcaatacataaatgcaccaaaagtgatatcaatacataaatgcaccaaaactgatgaaatgtagatacttctacaagatgtcaatctagcacacgtgataatgcaaactaatcataaagaggagttaaaacgtaatagggtatataaatattacaacataaacatacaaaaaataaaaacacagtatcagttataacatgctcacttgcatgcactcacttgcaaacatagaaacatgatacttttgccctgatttaatgtttatagaaaaaacattgccaggaaattcaaaactatagataaatgtgtgtgtgtgtgtgtgtgtgtgtgtatacatgtatatgtatgtgagtgtgtgcgtgtgtgtgtgtgtgtatttagagatactaggggtaaaagttagggtttaattcttttgtatatatcggtatcctctgatttttctacctttaacatatatcactttggaaacaaaagcacaatttattttaaaataatgatgtctaacaagcaaggcggtgcatgttgagaatgataaagatttcatcagtaatgatcttaacatcaaatagcctcttaagtatttttggagtagaagagttttggaaatttcaatagtaaggttctgaaatgtaatttttatattcattctttttaatcagcactagttaggtaaaatcatttttgattaggaacattttaaactcataaaggaggtgaagccattatgtgaaaaataaagatatcaataatacaacacaaatattatttaatgataccttattacttcttactgtataaaatcaggtggcttatatactcaggctgtctccttgttagtgatcctgatttagataaattgcttgagttgaggaaagccagatttcaaaaatctaaaggacatttgttataattagcaacttatgttgatagtaatgttaacatttgggaatatacgtttattcctaaattgttttagtacatttgagccactataagaaattaccataaactggctagtttataaaaaatagaaatttatttcatacagttttagaggctgagattttccagcttaagataccaactgatttgatgtcttgtaagggcttgctccctgttttggtgccttcccactatggtgccttcctactatgtccttacaatgtggaaggggcaagggagttccatgactcttctttgtaaaaagactaatccaatgtattagggtggaatcctcatgacctaatcacctaaaaagtccttacttcctgatactatcaccatagtgatgaggacgtaacacacatattttgaaagggtactactatgcacaccatagcacagcatagggataaacaaatatgttccatgtaaatggaaaccaaaagaaagcaggggggctatactaacattaactaaaattgaattttaagtcaaatctgtaaaaagaaacaaggaaggtcattatacaaaggagtcaattcacaaatagattataactattgcaaatatgtatgcactcaacatgggagcaatgaaacttataaagcaagcattaatacatctaaaggaagaaatagacaaaaatgcagtaatagtaggggacttcaataacccacattcaacaatggatagacagtctatacagaaatcaataaaaacattggacttgaactctatattagaccaaatggacctatcagacctatatagaacattccatttgacaacagtagaataaacattcttctcaagcacacaaggtataatctccaatatagatcatatgtggggccacaaaacaagtcttaaaaaattttaaaaagattgaaattacataaatttttttaacattgtcatatgaaactagaaaacaatagcagaagaaatgttaggaaattcacaaatacatggaaattaaacaacatgatccggaacaaccaatggggcaatgaagaaattcaaagggaaatttaaaaatatcttgagaaaaacaaaaatggaaaagcaacattctaaaaaacatatggtatgcaacaaaagcagtataaagggatgtttagagatatgaatgactccatgaagatcctaataaagcaagtaactttgtatctcaggaaactagaaaatgaagaaaaaaattaacccaaagctactggaaagaaaaaaatagtaaggtacagaacagaaataaataaaacagactggaaaaataatagaggatccacaaaactagaagttggcttttgaaaatataaacaagattgacaaacctttagctgaactaaaaaagagagaaggaacaaataaaattagaaatgaaacaggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatcaaaaaaacaaaacaaaacaaaaaaaactcatggcttcatgatggatggaatcctaccaaacatttaaagaatcaacactaatccttctcaaattctgtcaaaaatttaagagtgaactctcagttttattatatgaggtcaaaaatcatactgacaccaaagccacacatggacactacaaaaaacaattataggtcaatattcttcatgaatatagaggcaaaaatgctcaacaaaatacttccaaagtgaagacaacacattaaaggaatcattcgccataatgaaaagtaatgtatatctgggatgtaaagatagtatatatacaccaatcaattactgttccacaccgaattaaaagaatgaaaagcaaaaattgtatattcatctcaatagatacagaaaaagcatttaacaaaatcaacatcctttcatgataaaaagtctcaacaaattagccataaaagaaattaccccaagacaataaaggctacatatcacaggctcacatttaacattatactcaagagtgaaaagttgaaacatttttgtctatgatcagaaaaaaaaaaaaaaacaaggaggctcgctctcaccacttatgttcaacatagtgctggaaatcctggctagagctgttaggcatggaaattggaaaagaaaacagttgtctctgtttgcagatgccatgatctcattatatacatggaaaacccaaggacttcaccaaactttgctaaaagtaataaccaattcagtaaagttgcagggtacaagatctacagacagagccagttacatttctatacactaacagcaagctattgaaataagaaattgaaaacaaacatctaatttacaatagcatcaaaaataataaaatacttgagactaaatcaaagcaaggagatgagagttctgtactctgaaaactatgaaatattgatgaaagaaattgaagaaaacacaaataaatgaaaagatgtcctgtcttcaaggatcaaaagaatcaatattataaaattgtcttcaatacctaaaactccagattccatgcaatattgtcaatattctaaacacatctttcgcagaaatggaaaaaaaattctaaaattaatatagaacaagagacaccaaatagctaaagcagtcttacaagacaaaaaaggaagagacagcacactatcatgctctctggtttcaaattacactacaaatctataataatcagaacagtttagtcctgatacaaaaaagatacatagacagaattaaaagctccgaaataaaatcatgcatatataaaggcacttccaaatattcatggaaaattgaattaaaataagaaaattttaaaactacactttatttcttaacataagctccatcaagttcaacacacttttgaaaacagtgatacaagccatttagtccatccctaaagactcgatggttctggaactatatccatgttaagcagtctttttcacataattaactgaaacaatgggtaccctttgtaagattttttaaaattaggcaaaagaaagaagtcaggagaaggcaaaccaggactttaatgtaggaatgctcaaagatttcccataaaaattctcacaaaattgtttttgtctgttgagaggaatgagcaggagcattgttctggtggaggaggactctctgatgaagttttcctgggcatttttctgctaaagctttgaaaactttctcaaaacattctcttaagaagcaaatgtttctctttggccttccagaactcaactagtaaaatgccttggccatctcataaactgttgccatgatgttttctcctgactggcctgcttttgctttcattggaccacttccacctttggtatgccattgctttgattatgttttgtattcaggatcatactgataaactcatgtttcagctcttgttacaaatctttgaagaaatgtttcaggttcttattcccacttgtttaatacactttccgttaaaaactattcccttgctggccgggcgccgtggctcacgcctgtaatcccagcactttgggaggccgaagcgtgaggatcacgaggtcaggagatcgagactatcctggctaacacggtgaaaccccgtctctactaaaaataaaaaaaaatctgcgggcgaggtggtgggcgcctgtagtcccagctactggggaggctgaggcaggagaatggcctgaacccggcaggcggagcttccagtgaactgagattgccccacagcactccagcctgggcaacggagccagactcagtctcaaaaacaaaacactcttctcttgtctactacacctcatctgggtgcaatggtcttgggtctcactgaatggaaattttgctataacattgattttcccatcagaatttgtaagatgaactaattatggtgttgactattgattctgctcttagtcatcagtcatctttaatccagatgtgagcaaaattatttttttctcacaaattagtgtggctagtctgccgctgtgggcttcatccttaacattgtcttgcctctgcctaaaatgagttatctgtttctaaatggctgatttcttttggggtgttgtccccataaatttttcaataatttcactgaagctccatgacaagtgttggttaggatgtggaaaaaaggaaacacttgtacattatgggtgggaatgtagattgttacagccattgtagaaaactatatggaggttcctcaaaatattaaacatagaactatcgcatgactcagcaattccacttctgggtgtataaacaaagaaaacaaaatcagtatgtctaagaaatatctgcactctcatgttttttgcaggattgttcacaatagctatgatatggaaacaacttatgtttctgtcaaagatgattgaataaagaaaatgtggtgcatatatacagtggaatacattaaattctgcctttaaaaagaaggcaaatctgtcttttttaacaacattgataaacatggcagatattaagtaagtgaagtaaaccagacacagaaagacaaatgctgcatgatgtcatttatatttggaatctaaaaaacacctgagctcatagatatggagagtagaagtatagttaccaggggttgcacagtgggagaaatagagagatgtcagtcagaggatacaagttttaagacaaataatttctggagacctagtgtaaagcatgatgactatagttattaataatatattatatatttgaaattacaaagacaatagttcttaagtgttctgatgtcattcatacaaaaggtaacaaggtgagatattggatatttgattagcttcattatgataatcattataaaatgttatgtatatcaaaataatatgttgtataacgtgaatataaaaatttgtatttgccaatgatacttttataggggtgaaaaaattgattacattaatcagtaaaaatggaagttaatggaccaaaatattacttctaggttttgaaatataaatatgtctttttgtaaaaacagaaaggttttttgtttgttgtagttgtttgtatcaccttggagtcgtgtattttgatttattcaatctggatatctctggaaactggctcctcattgcttctcatgtgccctaattttatctgagtatttctctctttttttttcagcataacatgttctaagttcactttatatttcctctgcccaacattcaaaatcatacacctttcctagaaagtctgattatttttaaagcagaataaaatttagaactcaagaaccatgaagtattggtaatagatgggaatgtccaatactttggaaatataattattttcagggatttttggtggtaaaatctttgaaatataaataaaatataaaagtttgttgttctcactggattttacaattcaaatttaataatacatctgtgaaaacaactttagtatatacatgttttcatttttgtgagtatatggtacgtctatgtatgtatgaggtacataaaatattttgatacaggcatacaaggtgtaataatcacatcagggtaaatgaggtattcatcatctctagcatttatactttctttgtgttacaaacaatccaattatccctcttattttaaaatgtgcaataaattacttttgactatagtcaccctgttgtgctatcaaatactagatcttatttattctatctaactatatgtttatgctcattaaatatattcttctctcatttgtctttactgactcattcatgaaaatgtcaaaagtgtaatgaaacgttgctattagtagttaaactactaagtgaaaattaaaatttctttgtgtttattttgcccctagatagttgactctgagtgtgaatcttcttttcaaaaatgatttaaatacttcttatctctggttcaccctattaccgaatccatagagttgtatattaattttcacttgtgttcttcatgcttagattttgcttttttctttcttatatactaacaataaactgtctgaaaaagaaatttaaagatctattccttttctgataacaccaaaaaataaaattaggagtaaatttaaccaaggatctcaaaaatctatatattttaaacaatacaatattgatgaaacaaattgaagaagacacacataaacagaaaaatagcccatgttcagggactgcaagatttaatatggataaaatgttcatattacacaaaaagatgtaaggattcaatgcagtccccatcaaaattctaatgtcatttttcacagaaaaatgaaaaacagttcaaaaatatgtatgaaatgacaagagatcccgaaggtcaaagtaattttgattaaaaagaacaaagctggaggcattacacttctaaattttgaattatgatataatgctattataggcacgatagcatgacattggcataaaacaagacaccaataaaacagaatagaattcaatatattttcaataaagatgacaagaactcacatagggaaaataatagtctcttcaatacatcttgctgggaaaatcggatattcacacatagaagaatgtaattgatccactgtttcacactacataaaactactcagaatatatgtaagactgacatgtaaagcttgaaactataaaactgctagaggaaaataaaagagaaaaaaatacatgacattggtctgggctatgatttcttggattggttccccaagcataggcaacaaaaggaaaaatacacacattgtattacatcaaactaaaaagcttctgcacagcaaagtaaacaatgcccagagtgaagagacaactcatgagttggaaaaatatttgcaagccatatatctgataaagcgttaatattcaaaatatataaggaactcaactcaatggctaataaaaaggaattaaccaatttaaaaataggcaatgtacctgaatggacatttctcaaaagaagacgtaccaatggccaacaagtattattatcaacaatacaaaaaaacatcaagtgttatcaaacatgtggagaaaaggacacacttgcacattgttgatggaaatgtatattagtatagccattatggaaaatactatagagtttgtcaaaaatgaaaagcagaacatataatcaatccagtaatcctactactgaatatatgtacaaagaaaaaggaatcagtatgtcaaagagttatctgcattcccatcttcattacagcattatttataatagccaaaatatggaatcaacttaagtatccattacagatgaatagataaagaaaatgtggtctatatacacaatgtaatactattcagctttgaaaaaaggaaatcctgcattttcaagaacatagaataaacagggaggacattaagttaggtggaataagacagacaaaaccacatgattgcacttatacatgcaatccgttgtaaaatatggtgactttagttaacaataatatgttgtattcttgaaaactacttagtgtagattttaagcagtctcaccacacacaaaaatgagaagtatgtgaaggaaagcatatatttattagcttgatttagccactatctaatgtatacatatttcaacacaatatgttttacataataaatatatgcaattttatttgccaataaaaaataaatgaaaatgtttacaaaaagagaatatgtggtatagatacacagtagaatactatacaaactaaaaagaagacaattttgtcaatagggaaaacgtggatgaatctagtggacattatgctatctaaaataaagtcaacacaaagaaaaatcctgcatgatcttattgatatgtggaatctaagaaattcaaatttacagaaggtgagagtagagtggtggttaccagaagctgaagggatggcggtgtttctaggaggtgttggtcaaagggtataaattttcagttagactagaggaatacattttactatctatttcacagcatggtgttcacacttaataataataataataatagtgataatattatatatttcaatattgctgagtacatatattctatttaatatatttaagcctagcctttctaactactacagaaagagaagctaaatgtcttttgtaagtatgcttatcttacaaaaaataagttcatttgacattcatgtaataaatctaatctttgttttattgattttcagattaacaaagaccttatctgaatactctttacaacttttatgtaaatctaaaattattccataggagaaattttatgtaaaaaaagataaaagtatgaagcatgtttcagtttgggtatttcactttgtattcactgaatattgaaaaaattaaaatactatcaactaatacataaagtcatataaactcctaaataaccgctgaggaacctacttacttttgtgtgtcattttggatagtcaaggttttttgctatgctatactttaaaaagtaattaatgaaggggctgactctttttttgttaatagcacacttaacaatattagtggattcctggtgttcttcactaaggtccttggtcagtaatttctgattatattttatgcaaagaactttgaaaacaccttgtgctgtattttaaagtttattatcatccatatttctgaccaatcacagatgttgcaaaaggttgggacacttggaaaaataaaattattttcaaaaagattatttttttatagaatttcaaaaacaaccatctttaaaatactaacaatagttttaaaaattacaatacttttataaagtttttacgaacactacttacagatagagtaaaatttcattataactgaaaatgttttcagtaacctgttatacttggctaagtgtcattattcaactgaaattccacctctcttcaacatttacgtatatattttcctgaagatttttgtcttatgttttgcagttattttaaagttatggaggaggttttgcttattttactatatttactatatggtttgtctttagcattattgatagatctttttcttctaaatatgggccgtattttctgcttctttacatatctagtagtgttttattctactctggtcaatgccaataacacattgtgatgacagccatggaatataaaagttacctatgggtttgtcatatatgctatttatggtattggggtacttttcttctatacatatgtttttaaattttcctgtgcacatcataggtgtacagtaggtgtatgtattgatggagtacttagaatgttttgatacaggcatacaatgtgaaatgagcacatcatggggaatggggtatacatgccctcaagtatctttcctttgagttccaaccatccaataatactgtataagttattttaaaatgtacaagtaagttatcattgactatagccaaccgattgtgctgtcaaatagatggacttatttattttttctattttttttcgtacacattgaccatccccatctcccctctagccctataccacccttcacagtctctagtaaccatccttcaactttctatgtccaagagttcaattgttttgatttttagatgccacagataagtgagaacatgtgaggtttgtatttctgtgcctggctaatttcacttaaaataatgatctccagttccatccatgttgttgcaaatgattggatctcattctttattatggcaaagtagtactccattgtgtatgtgtgccacattttatttattcattcatctgttgatggacactttggtggcttccaaatcgtagctattgtatacagtgaggcaacaaacataggtgtgcagataccgcttccatacactgatttccgtacactgctgttgtatacacagcattaggatggctggatcataaggtagctcaatttttagttttctaagaaacctccaaactgttctccatagtggttgtattaatttacattcccaccaacagtgtacaagatttccctattctccacatcctcattagcatctgttattttctctcttttccatataagccattttcactggagtgagatgatatctcactgtagttctgatttgcatttctctgatgatcagttatgttgatcatcttttcacatgtctgttttccatttgaatgtatccttttaagaaatctatattcagatcttttgcccttttttgatctgattattagatgatttctgatagagttgtttgagctctttaattattctggttattaatcccttgtcagatgggtagtttgcaatattttgtcccactcagtgttatttcttcactttgttcattgtgtcctttgctgtgcagaacatttttaacttgatgtgatctcatttgtccatttctgctttgcttgcctgtgcttgtgagttattgctgaagaaatttttgcccagaacaaagtccttgagattttccccaatgttttctggtagaagtttcatagtttgaggtcttagacttaagtctttatccatttgatttgatttttggatatggtgaaacatagaggtctagtttcattcttctgcatatgaaaatccagttttcctagaaccgttaattgaagagactgtcttttccacaacgtccctttgtcaaaaatgcattcactgtagatgtgtaaatttgtttctgtgttctctattctgttccattagactgtatgtctgtttttatgccagtactatgctgttttagttactacaactctgtagtataatttgaagtcaggtaatgttattccttcagttttgtttttattgcttaggatagctttagctattttgggtacctttagcttttgtggtaccataaaaattttaggattgtttttctctattactgtgaagaatgtccctggtattttcatagtgatttcttgaatctgtagattgccttgggtagtatggacattataacaatattgatccttccagtccatgatcatgaaatatcttttttatttttggtgtcctcttcaacttctatttttagtgttttactgtttttcttatagagatctttgacttctttggttaatatctaattatttatttttatctgtggttactgtaaatgggattacctttaggatttttttcagattgtttgctgtcaacatatacaaatgctactggttttttatgttgatattatatcttgcacctttactggatttgtttatcagttctaatagttttctggtgattaccttacgtttatcgaaaaaaacttataccatctgcaaacaaagataatttggcttctttcttttcagtttggatacctttatatccctctcttgtctaactgctgtagccaggacttccagtattatgttgaataacagtggtgaagtgggtatccttgtcatgttccagtactttgaggaaattatttcagactttctccattcagtttgagagtagctgtgtgtctgtcaaatgcagctttgattatgtttgggtgtgttccttctatcttcagttttctttagtgttttatcatgaaggattttgaattttatcaaatgcctttttggaatcaattgaaataatcatgtggtttatatccttcattgtgttggtatgatgtattacattgattgagttgtatatgttgagccatctttgcatctcaaggataaatcccatttggtcatgttgaatgatctttctagtatgctgttaaatttgtttgctattcttttgttgagaatttttacaattacatttgtcagagatattgacctgtagtattctttttttaatgtgtctttgtctgattttcttttcagggtaatattagcctcacattggaagtatttgctcctcctcctcctctatttttcaaaatagttagagtagaattggtactagttcttctttaaatgttagggagaattcaacagtgaagccaatatgtcctgagcttttctttactatgagactttttattctggctttgatctcattacttgtattaataattgatctgttcaggttttggatttctttctgcttcaatcttagtaggttttatgtgtctaggaatttgtccatttcttctagattttccaatttattggaatatcattccacatagtggccaataatgattctttgaatttctccaggatcagatgtaatgtttccttttcatttctgattttatttatttgaattctcactctttttctcttagtctggataaaggttgatcagcatgtttaatattttaaaataacaacttatgtttcattgatctttgtattttattcatttcaatttcaagtttatctgctgtgatatttattatttattttcttctaataattttggatttggattgcccttccttttctagttctttaacataaatcaccaaattgtttatttgaagtttttcctttcttttttatgtagtcacttatagctataaatttttctcttggtactaaaactgctatatcccataggttttgtgtttccattatcatttgtttcacaaaatattttaatttcttcattgatccactgtgcattcaggggcatattctttaatttccagattctttaattttttgtttcaacttgccataaggattgcaaatactatcttataaccagaaaacaacttaacactgtttgcataaacaaacaagccaaagaaaactcataaatactctccaccttaattttcccttctgctttcaaactttttgttgtttctatttttatcttattgtacagactatgtcttgaaaatctgtagttattatgtttcattagttcattatttagtctttctacttaggatattagcttacacaacccagttgcagtgttttaatattctgtatttttctatgtacttactattaccagtgagatttgtgtcttcaggtgattattgttcatgaatttaattttttgattgaaatattccctttagcatttcttgtaggacaggtctggcataataaaattcctcaccttttgcttatctgagaatgtctttatttcttctttatgtttaagggatattttcaccagatattctactctaggataaacgttatttttctgtcagcatgtgtcatatcactcctgtaaggattcctctaaaaagcctgctaccagatgtattggtgctccattgtatgttatttatttctttgttcttactgattttagaatagtctctttatccttgaccttagagaatttgattattaaatgagttgaggtagtcttctttgggttaaatctgcttggcatcctataaccttctagtacctgatatagatatcattctctaggtttgggaagttctttgtgattatccatttgaataaactttctactcctatctcgttctctacttcttccttaaggtgaatactcttagatttgctttttggaggttattttttagatcctgtaggcatacttcattgtttttaattctttatttttttgtctcctctgactgtgtattttcacatagcttgtcttcaagctcaacaattctttcttctgcttgatctattctgctattaaagaatagcacgtgtaatatcttcttcagtatgtcaattgcatgtttcggctccagaatctctgcttgattttttaaaattatttcaatctctttgttcaatttatctgatagagttcagaattccttctctgtgttatcttgattttctttgagtttcttcaacaaaactattttgaattcgttgtttgaaaggtgacataactcagtttctctaggattgttccctggtgctttgtttagttcatttggtgaggtcgggttttcctggatggcgttaatgctagcagatattcttctgtgtctgggcactgaagagttaggtatttattgttttcttcactgtctgggcttaattgtaaccatccttcttggcaagatgttccacatgtttgaaaggacttgggtgttgtgacctaagctgtaacttctttacagggtgtcaaaatcccaccaatgcagtggttcttgcagacttctgggggtactctattgatggtcttgcacatgatctgagagaattcagagtgatgagggcccctggaccagggtggtttccaggggaccagtttcaaaaaccttagatgtctgcttgatgttatatggtactgtatctgggctggcagtcatattgcaagttaaaatgttgtggggtggggtggggggaggggggagggatagcatttggagatatacctaatgttaaatgacgagttactgggttcagcacaccaacatggcacatgtatacataggtaactaaccttcacgttgtgcacatgtaccctaaaccttaaagtataataataaaaaaaaatcctcctcactgttccctcccctttccaaagtcagaggagcctcaccctatggtctaacaccactccaggccatgaggagtactgccagacaactgctgatgttcccttaaggtttaggtgctcctaagtcagtttgtggtgaatgctggctagcctaggattcacccttctgggaactgggctcccatctggtccatggtatgtccaaaaatgccacccaccagtcaagtccaggaactggggaccctgggagcccaggtggttctctatcccctgtggccatgctggtacctgaagccagcaagtctcagaggctcacctaaggccctcaacatagtatctgggtatcactgcaggttattgagggccaagggctcttcagttaggctgggtgaatgctgccaggactgcatcatttccttcagggcattgggttcccttttggttcagggtatgtcaagaaatgtcatctgggagctagggcttaaagcaggggcctcattcctttgacagttgccctatcctgctttgtctgagctgatatccaagatgtaagacaaagtcttccccgttcttccctctcctctcctcaagcagaaggaaggggtttcttttggagctgtgaaatgtgaagcctggggttaggggttgggtgatgccagcatgctcttggctgcctcagctggtgcagttggtgtctctgaatattctgtgtcttcccccagtccatagtctctgagcctagttcagcactaagactcacatatgtgtgcagtccttatgtcctagactgtctttctagtttatttagagacacaatgcatggtaggtagccctaggtggcaagatttgtgggaacttgatttcagacccctgcggtcagcaataccgtcatggctagcattggtttaaatactccctccatgggaaggggttagctgagtttggtttggctttcctttctgctctaacagcacagcattttgttcaatgcctcacaattgctatgttctccctccctcagtgcctagagcaaggctctgtacatcatggcacagctgcaagtgtggggagaggggaaagggtagtgtcagtgactcaagattgtctgacctatctcttacgtgcctctttcagggatatgaagttaaaaccatgtactatgagtgctaatctgataatgttttcattttatgaaggtgtttttttttttttctgtgtacatagttgttaacttggtatctttgaaggggaatggttggtgtctcctattccaccatctggctctgctctgcctaatttgtggagactctttatcatgaagaaatgtcaaagtttctcaaatgtttttagtacttctatgaaaatgatcatatagttttgttgattctgttattgtgatatgttacatctattggtttgtgtatgtctgctcatctttattttatgcatagtttgaaaaaaaatactaccagttttttatactgtttggttgaattcagcagtgaagataacaggcgttgggcttttttgataggtgaattttattactgatttaatcaacttactcattatttgtttgttttgattttctatttattcctaatacgatctgtattaggaatttttattttaatttgtatttgtattttacaagctattttatttttagcttgtatttgtatttgtagctgtatttgtattttagcttgcttctcccttagattcccccatgagatgtacctaaagaaaacttggaccaagtgaaaggcaaggcattatctggtagcagctgctggtagcagctgagatcaccaacagtagctttccttgcttctggaagttttcctaagaaacatccactgcagtacaatggataattagtggggcatcactaagattcctgaacttcggaattttctggaaatagcatttatgacctttgttccctcagttcttccagtagttgcagaagcctttcgttccctttattgatactctctttactcaaaaaatgagagataaaataaattaatgttttatattacttttggattcagtccattactgtccctaaataatattttacaagtacatttcagggaatcaattccacagatggttgtgaaaccactaactggaattattgaagcattttgcaaaactctctgaactttgatatttactaagtgaccttaaaggcctagcttcgtggtagtttcctcaaattcggaatcacccttggtaactaataatgaaagatttcaaactccaaacagtacaactgaaacttttgcattactatactactgagaatatctaacatgttgttactaattaatgtcattctaaccttgtgggtttcctatgctaatggacaaggtaaattgaaagagatctaaacactcagctcccatcttaaatgtaacttcatgtaatatctagcttcctatgtctccatgtctacaattttttatgaaccaaagaggatttattcactatgctagtagaaatagcatattttgtaagactataacagaaattaattttatgaaatattatctcattttaacttaaacaatgaataatattttctttgttttataagttctacagtgtaaaagacatttaatattgattatggagatatgtgaatatactcatgaaactttaagtaggaaacatgtcactagacagattctaaccttaaaatgttcagaagtttcttatttgtaatgcaaggggagtgactgatattttcataatcttacagatggtgattttttatagattcatatatcaaaacatcaaataatacattttaaattctgcagtttcttttatttctataataccttaagaaagctgctaaaatgaattaacattaatatgaacttaatatttcaacaagattagcaacatgtaaatcacaacatgtaaatcacaacatgaatataatcaaaaagtagactatatgcttaacttacttttaaatgacagtaaattttgcatttctgagctcactagcaaatgttcaataaataaatacataattattttttatagctttatgttattgttcactgatttgttttctcctcaacagtcatatattttctatattaactacctttttgaatgcaggccttgcatattaaagaactatatcgtaacattagcagtggaaccacatgggtcaaatgtcatggacaatcaaaggtttgtggccattaatgaagaatacaaattttgtaattatccaaaacttcataatatttcaacaaatgtagtggagggtaatactggaaatccaattatcaatttatgagagtatcttttccctcagcctctcttctcaaagctatgccactttatttgattctaggtaaagagctttaggttttacagtattatctatcacatgatttgctagttttatttgttgtgcaaaatcaaacttgatctgtgctaaaatggaaaaaaaaggaaattctcctgttatttcctttgttaactgaactgatacaggtacatttttttcaaataaagattaaatagattaaagtagaatgaaaagaagaaaagtagtaccattctgaaatgactggaattagaaaagcatatgcactatactttcttacttactttcttaaaagcactatagaaaagaatgatgacaaattcttccttatctgatattccagttgaaaacttgtctcctccaatgaactctttgtaagagtaaacttgagcaaaatgtcttgtaaatttgggtcgcacctatatttctcaaaggagaaagtaactcattgggttactttcaaagtcttggttagagagaaacatctttgtgtattcagtagcattggctcaattgcatcccgccaaaattcatttgttaaagtccaaattcccaatacctgagaatgtgactgcatttggagaaggagtgcttaaagatgtaattaagttaaaggccaatgattcaggtgggtcctactccagtataactggtgtctatataggaagagaaaataagaacacaccatatagagaaagatcacgcaaggcatagaaagaatacaaccatttacaaggcaaaggaagaggtctcagaagaatccaatcctgttgacagctctatctcaaactattagcctccagaactgtgagaaaataaatttctatgaaatcagtggtactttgttatggtagctctagcagatgaataccatgatatttacacaatttattaaaagaacattaataactaaaaataattttttactttttactcaagaatatatatatatatatgtagccaccacacagattttagaggctattcatcagaatttggtaattacatcttgggtgtattttcctgctgatttttgtcttgttgaatactttatgtgtatatatatctgtattcatctatattcagaatctagtaaatcaaatctaagaaagatttttcatatcattaatgaaggacatactttgtgaattgcttatgctaataaaatttttttaatggtagttgatatttcagttctgaacaataaaatcggcacaccaattcttttggaaaccacgctatttgaaagacaaacttgacagaaaatttgtaattgtaacctattataatgttcattgaatttgtattggccattatttcttccatcaagtcataagttatttatacttatttaaaaataggttgtcaataacattatttttaattatgaatatcctttcagaattgtataaattttatattcatctactagagttgccataacaaagtgtcaagagtgacaattaacattgtagagcagggttgcttttaaatcccttttaaactgatcattacagtaccaaatgcattacagttaattgccattgtacttctttgggatgctgaaatttgtttcacatctcactaagaagatggcttctgtgtatatttcatgtgcccccattaagctttggcataacataagagcccatactttccttgacttttcctactacagactaagtttcaataatttctctatgaaattccagtgccttttagtgggaagaacgatttttagaaacaaacctaaaccatgaaaaactcacttcaggttcgaaattatcgttgactaagaaaaataatttttggccgagcaggatggctcacacattaatcccagcactttcgagggccaaggcgcgcagatcacttgaggccaggagttggccaacatgatgaaatgctgtctctactaaaagtttaaaaaaatagctggatgtggcggcacacacctgtaattccagcttcacaggagactgaggcaggagaatcacttgaacccgggagacagaggttgacgtgagccaatatagtgccactgcactctagctttggagacagagcaagactattaaaaataaaaataaaaatgaagaaaaaaagaaagatttaaatgatttcctttagtttatgtccctttctacctcggactaaatatcctgcaatcataagaaaatgtaagagtatctcaggaggttacacagggccgggaagtttcgattttccaatacggaggagacactcagcagaaaactgtgcatccatgcttgagggactgggtcagagaaggtgtcatgcgtcgcccaacaagcctctggatccagttctgtaactagcaaacgcttccctcaaagtaaagatgtcacttctctgaacttagtcttctcatctgcacactaaagctgttgtgccactagcgtctttctagttctctctggtttatgatgattcaaacttaacttttatttaattatattcttaagttttcataacaaatagaatgtaaatactattttctatcacttgttccataattatagagtaaacataaatgatatgctatttaaattgtgatgttgttcaacattctataggtatacatacctatagaatgtaagaatatatacatatttgtacattcgtctatgcacttattttttatgtcaataatatatcttatctgacacatgaattctaactatggtaagaatgcatgccatcgcatacaaacaaaatgccacaaaactaaacaaaatgttttatatctggagataatttgctacatatcagattttttatgttacagtcatatttcttgtctctcttttccaaaaaacaatcattgctaatgcgtgcaccctgaactggcagcttgagcttaacttggtatagttgtagataagctcagtttaaattaatgctgataaaacctccagaattgctgaagagaccatactatgttagtagaagtagagaaagtgaaatgaggttcttgtcctgttagctgacttgagatccattaaagattttaagtggagaaataaaatgaccagatgaaaggtcattaatttatacacagggaaatagattacaaagatgagaggtcaggatcaggaaactagttatgattgctgcaatctcagaagaaaatggttgagagacgatgtttatcaaaggttattgccagggtttttttgcgcctgtttgtttgttcgttttgacagaaaaaaattgagtgaaagggaacaccacaattgcagaagttcagttattattgagagaggtaatgagaatgattgacatgaatttcccccaaaaaatgttctgtcaataattactatattatgaacaaatagagcatggaatatttttatagctgactcagcgaaaatagctattacagcaaacctatgtctatactgaaattcacatatacattcaaagaatattactctataccatttatctcaagagaactaatcttcaaagcaaaagaaatcagcaacatgtttttaattaaaattttaacttccttcaaaaatgtctttttggccgggcacagtggctcacacctgtaatcccagcactttgggaggccgaggagggcggatcacgaggtcaggagatcaagaccatcctggctaacagggcgaaaccccgtctctactaaaaaatatacaaaaaaaattatctgggcgtggtggcgggcgtctgtagtcccagctactcgggaggctgaggcgggattattgcgtgaatccaggaggcagagcttgcagtgagcggagatcgagtcactgcactccagcctgggcaactgagcaagattctgtctcaaaaaaaaaaaaaagtcttttttatttatctgttaagaacagataaatcattcatgaggcattcaagtcaaaaaagaatttttatttttttgttggcagatttacttagtggaaacaacatttgtatttagctttaaaagtaaattaagtggaggaaaatgaagattttcattaataaccctaatattaatagacaatggtggtactgaggagaacatctatctctttcaggcttcatgaggaaatgatgtttttcagtgtcaacaaagtactctcaactgtgtggtttgcccaccaaatatcatgtctgtaataatataccgtacttagcctaccacgttttaaaatgattggtttccaactatcatggcatagaagagaatatatagatagttgaagagttaaagaaattatagcataagaagcatgcaaaaagatagagttatagcattataatgactgtcttgagatatttcaaaacatttatgagggggagtaagttagcttttgatgaggactgtcacagtcagtgaagcaggtaacagtattatccaacatcgaatcagaggtcaagtgattttctaaaagtgtgacctatacggatattgccctatgtcgggggtgggggtagaagagttgatctcttctgagccctccacgttttaagttgtatgattcaacattgtacatacaaaccttgttttaattatactctatttttaaaaactgcagttagcttttgagttagctgggtgtgttgacccaggcctatagtcccagctactctggaggatgaggtgaaaggattgcttgagcccaagaggtcgaggatagagccagccaggatggcacccctgcgttccaaccgggctgacagagagagacctcttctcaaaaacaaacaaacaaaggaacagaaattcacttttttgtgtattttattaagaattttaacacctctgttcaacagggacatcagcctgtagttttctttttgtgttgtttccttgtttggttttggtatcagggcaatgctggcatgctacaataagttggaaaaattccattttctttgcttttggcatagtttgagaaaaattactctgagtttttttttttttaatatttggtagaattcagcagtgacgataacaggttttgggcttttttgatgggtgaattttattactgatttaatcaacttactcattatttgtctgtttagatttctatttattcctaattcaatcttggtatgttgtatgtgtccaaaaatttgtccatttcttccaggtataccaatttattggcaaacaattgttccttatagtttttatgatcctttgtgtttctgtagaaccagatgtaatgtctcccttttcctctctgattttatttatttggatcgtctcccttatttttcttagtctaagaaaatgtttgtcaattttttttaaaatctttgctttactgattttgtcatacttacatttagtctctgcgttgtttgtttctgctctgatctttattatttctttttcgacttgtttttagtaatgttgttcttaaatttttagctccttaaggtgcaatgtttggttgtttatttgagagatttattctttttgataaggcatttattgttataaaatttcctcttagaactggttttgctgtatctcatctattatagtatgctgtgcttccattgtcatttgtctcaaaaactttccaaattttttttagttccttcattgagccattggttttaaatgtacatgttgtttaatttccaagtgtttgtaaagtttccaagttttattctgatgttaattgttgtataccattatgatcagaaaagattcttgatataattactatttttttcaacctgttacaacttgctttatgacctaacttatgatctattctggagaatattctatgtgcagttaaggagaatgtgttctgcagcagtcgaatgaagtattccgaaaatgtctgttagatctatttggtctagaatgttctttaagtccaatgtctttttgttgattttctgtgggaattatttttccattgctgaaagtggggagttgaaaactcctactatcattgtattgcaatctctctctctctttagagctattaatatttactctctctctctctctctctctctatatatatatatatataggtgctctaatgttgagtatatatatatatatatatgtttacaattcccatgggtatatgctgatttgatgcctttatcattatataatgactttcattgtttctttttctgtttttagttaaagtccattttatctcatttacatatttctgctcctgctcttcttttccaacagcatggaatatctctttctctccttttactttcagactatgagtccttagaggtatcatgtgtctcttgtagcaagcatagagttgagtgttttctttttaatccactaaccgactctatgtcttttaattgaataattcaatccattgacattcaaggtaattattgatagataaagattaactattgccatttggtaattatattctagtcatttggcagattttttttcttcctttcttcttcactcttttgtggttaaatgatttttttctatcagtgttgtttgactcttctctttttacttgtagtgcaattattatggatttgtgctgtggttattctgaggcccacaaaattcttatatttataacagcttattttaccagataacaacttgtgattcactttttaaaagaaaaaaacaactctacatttttactctaccttatcacacattttgaatttttgatgttacaactcacaactttttaaattgcatactctctaaccaattttgtagctattatttttaattgtttgctatattatagcttcatttctaagttctaggatattcagggtggtaatcttggctctcagtggttgcttttaagtttctgtaggagggagagaagctggagaactcctacactgcagttttgctgatgttattctctccatgattctcttattttaatgaacagtatcttaaaccacggcaagtatagtaatgtaaaataaagaataaacagaagaagtcaatgagagaacatgtgtggacttgagttatattcttccaacaaaacagaaaattttatatatatatatatatatatacatatatatatatatatatatatatgaatgtattgtactaaaaataaaagataccccaaaacacaactttaaaaacatttaaatatcaagaatatgctgaaacttttgtactcagtatgatctattgtgagttctgaaaatcagtatgctactctaaacacataaaaatacagagagtggaatgggatccagacacaccggtttgttttcatacaaccttatgtaattaagttgggtactggaaagcaaaggacaacagaaaattttagagacatggaccctgagagttactcattaatgattcatctgtatgtggaagaaactcacctattttccagtgtttaattttaaaattagtgttctcattttaagaagagtatgtgggataagagtattttgaccatttgtggggggggggaaaaaaaccttgccatgccaaacagcaggattttcacgagatgagtgtgccagatgtttattttcaacttgaaatcaacccagttcctatcttcattttcttctgcattgcagaagatcagcctgaaactacagtttctgaagttcctttctccatagcttgcttctcccttagattcccccatgagatgtacttaaagaagacttggaagaagagaaagacaagggattatctggtagcagctgctggtagcagctgagatcaccaacagtagctttctttgattctggacgttttgctgagaaacatccactgcagcaccatagataattagtgagggcatcactaagactcttgaacatcagaattttctggaaatagcatttttgacctttgttccctcagttcttccaatagttgcagaagcctttcgttccctttatggaaactctctttactcaaaaaatgagaaataaagtaaattaatgttttatgttacttttgcattcagtccattactgtgcctaaataaaattgtaccagtacatatcaggcaatcaaatccacagatgattgtgaaaccactaactggaattattgaagcattttgtaaaactctctgaactttgatatttactaaatgaccttaaagcccctagcttcatggtagtgcacttaaattcagaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaaatagaatataaacttacattggaaagatagtaagttttgattggcatttctgagttcactagcaaatgttcaataagtaaatatacagaaaatacttttcatagcgttatgtcattgttcactgatttctcctagatagtcatatattttctgtattaattatctttttgaatgcaggccttgcatattaaagaactatatggtaacattagcagtggaaccacatgggtcaaaaatcatggacaatcaagggtgtgtgtccattaatgaagaatacaaattttgtaattatccaaaacttcatatttcagccaatgtaatggagggtaatactggaaatcccattatcaatttatgagactatcttttccctcaaccactcttcgcgaagctatgccactttatttgattctagggaaagagctttaagttttatagtattatctatcacatgatttgctagttttatttgttgcgcaaaatcaaacttgatctgtgccaaaatggaaaaaaaaaggaatttcaccagttatttccttttttaactgaactgttacaggtacatttcttcaaataaagactaaatagattaaagtagaatgcaaagaagaaaatactactattttgaaatgactggaattagagaagcatatgcactatattttcttacttactttcttaaaagcactatagaaaagaatgatgacaaattctttcttatctgatattccagtggaaaacttgcctcctccaatgaactctttgtaagagtaaacttgagcaaaatgtcttgtaaatttgggttgcacctatatttctcaaaggagaaagtaactcatttagtggaataacatcttgggtagagagaaacatctttgtgaattcagtagcattggctcaactgcatcccgccaaaattcatttgttaaagtccaaattcccaatacctgagaatgtgactgcatttggagaaggagtgcttagcgatgtaattaagttaaaggtcaatgattcaggtgggtcctactccaatataactggtgtccatataagaagagaaaataagaacacaccgtatagggaaagatcacgcaaggcatagagagaaaacaaccatttacaaggcaaaggaggaggtctcagaagcatccaatcctgttgacagctatatctcaaactagtagcctccagaactgtgagaaaataaatttctatgaaatcagtagtactttgttatggtagctctagcagatgaatactatgatatttacacaatgtattaaaagaatattaataattaaaaataactttttactttttactcaaggatatatatatatatatacccaccaacacagattttagagggtattcatcagaattgggtaattatatcttgggtgtattgtccttgctgatttttgtcttgttgaatactttgtgtttacatattatctgtattcatctatattcagaatctagtaaatcgaatcagcaaatatttttcatatgattaatgaaggatatactttgtgagttgcttatgctaagaatttttttttaatggtggttgatgtttcagttctgaacaataaaatcagcacaccaattcttttggaagccacgctatttgaaagataaacttgacagaaaatttgtaattgcaacctattataatgttcattgaatttgtattgaccaatatttcttccatcaactcataagttatttacacttatttaaaaacaggttgtcaggaaaattatttttaatcatgaatatcctttcagaattgtataaactttatattcatctactagagttgccataacaaagtgtcaagggtgacaattagtaatgtagagtagggttgcctctaaattccttttaaactgatcattttcagtacccaatgcattacagttaattgccattgtacttctttgggacgctcaaatttatttcaagtttaactaagaagctggcttctgtgtatatttcacgtgtccccattacactttggcataacaaaaggtcccaggatttccttgacttttcctactacagaccaagttccaataatttccctatgaaattccagtgccttttagtgggagaaacgattttcagaaacaaacctaaactatgaaaaactcactacagtttcgaaattatcactgactaagaaaagtaatttttggtcgagccggggggctcctgccttaatcccagcactttcgggggccaaggcgcgcggatcacttgaggtcaggagttggagaccagcccggccaacatgatggaacgctgtctctactaacaattcaaaaaattagccggagtggcggcacacacctgcaatcccagctactcaggagactgaggcaggagaataacttgaacctgggaggcagaggttgcagtgagccgagatggtgccactgtactctagccttggtgacagaacaagactgttaaaaaaaaaaaaaaaaaaaagaaaagaaagaaaaattaaaatgatttcctttaatatatgtccctttcttcttcagactaaatagcctgcaatcataagaaaatgtaagagtatctcaggaggttacacagtgcagggagatttagattttccaatatggaggagacactcagcagaaaactgtgcatccatgcttgagggactgggtcagagaagctgtcatgcgtcacccaacaagcctctggagccagttctgtaactagcaaacacttcccacaaagtaaagatgtcacttctctgaacttagtcttctcatctgcacactaaagctgttgtgccgctagcctccttcccgttctctctgatttatgatgattcaaacttaaagatttttccttagtgatattcttaagttttcccaataaataggctgtaaatattattttctatcacttgttccagaattatagaagaaacataaattatatgctatttaaattatggtattggtcaacattctatatgtctacatacatatagaatgtaagaatatatatatatttgaacattcgtgtatgcacctatttttttatgtcaataatatatctcatccgatacatgaattctaactatggtaagaatgcatgccatcgaatacaaacaaaatgccacaaaactcaagaaaatgttttatttctggagataattggtacatttctgattttttttaatgtttagagtcatatttcttgtttctcttttccaaaaaacaattattggtaatgtgtgcaccctgaactgacagctttagcataacttggtatagttctagataagctcagttcaaattaatgttgataaaacctccagaattgctaaagagaccatactacattagtagaagtagagaaagtagaatgaggttcttcttgtcctgttagctgatttgggatccattaaggattttaagtgtagaaataaaatgaccagatgaagggttattaatttatacccaggaaaacagattatacagatgagaggtcaggatcaggaaactagttatggttgctgtaattccacaagaaaatgtttgagagaaggtgatatcaaaatttatctctaatatgatttattacagtaaaaattatttatacttttttgtttgttttttattgcaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagtaagtaatcctctgaactgctacacatgtataaaactttaaaagattaaagagaggagagcacataattgattactcttgtcttatgtaacagaaatagggccaagaaatgagttgttcaagcaaaatgaccaaaatagatcttttctattatgaggagttcttgaaaatcatatgaaaaataaatatagagactttatgagaatatctatatagtttatacatattttaattatgaaaactaaagagaagtaatattaaatattgacatttcctcttgtacaacctttgttagtaattttggttcatactaagttgtacattatttttggatgtttatgcgatcttatttaaatatggtaacaataattttaatatactttttgtgcaaatttatgtttctcatttactttatttatttatcattgctatgtccttaggaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagtaagtacaccgctctgagatcccagcatgttcatgtctttctaagtaacacggacgacagtctcagacttgtctatattaactgtggcaaaatgtttttgtcaacttgttttgccaacggacctatttagttttacttttttaattgtgtgaatatacaaatttcttgataagtacatagcaaaataaatgctcctattaatgggcattagtcaagaatacagtaaaagaattagaacacaatacttgttggctaaataaagtcatattgaagcggcattaatgtctcgggtaaatacccgaggttcgtcatcttgcaccaagaagattaagtacaaatgggtattctgggatcttgtacatattctactctagaaggtttcctacagtatttattcaaatatacatttatataaacagttccttcttttttcacatgttgctaatgattggtgatgtcacattttaatatttacaagttgagtggctataaaatggtatagcattgtaatgtaaatttgcatttcttttactaccagctggatttagaatacatgttcacagtttaattggtatttaatgattctaaaatttggaaatgcagtttgatttcttttatttatctttttgggagttttggttgttattagttggaatcatcttaataattctgaaggtaaaatctcttttaattatatgtaatgcaaatgcattctctttgtggctagtattgttctttccttttttctgcattatgaacaagttgctcattttactaaataattgtcaatcttttttcatgatgaatgttttttggttctttttttatattttattattattatattttaagttttagggtacatgtgcacaatgtgcaggttagttacatatgtatacatgtgccatgctggtgtgctgcacccattaactcatcatttagcattaggtatatctcctaatactatccctcccccctccccccaccccacaacagtccccagagtgtgatgttccccttcctgtgtccatgtgttctcgttgttcagttcccacctatgagtgagaacacgtggtgtttggtgttttgtccttgtgatagtttactgagaatggtgatttccagtttcatccatgtccctacaaagaacatgaactcatcattttttatggctgcatagaattccatggtgtatatgtgccacattttcttaatccagtctatcattgttggacatttgggttggttccaagtctttgctattgtgaataatgccgcaataagcatacgtgtgcatgtgtctttatagcagcatgatttatagtcctttgggtatatacccattaatgggatggctgggtcaaatggtatttctagttctagatccctgaggaatcaccacactgtcttccacaatggttgaactagtttacagtcccaccaatggtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcgtaaatgtcttcttttgagaagcatctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcggaagctctttagtttaattagatcccatttgtcaattttggcttttgttgccattgcttttggtgttttagacatgaagtccttgcccatgcctatgtcctgaatggtaatgcctaggttttcttttagggtttttatggtgttaggtctatcatttaagtctttaatccatcttgaattaatttttgtataaggtgtaaggaagggatccagtttcagctttctacatatggctagcctgttttcccagcaacatttattaaatagggaatcctttccccattacttgtttttctcaggtttgtcaaagatcagatagttgtagatatgcagcgttatttctgagggctctgttctgttccattgatctatatctctgttttggtagcagtaccatgctgttttggttactgtagccttgtagtatagtttgaagtcacgtagtgtgatgcctccagctttgttcttttggcttaggattgacttggtgatgcgggctcttttttggttccatatgaactttaaagtacttttttccactttggtgaagaaagtcattggtagcttgatggggatggcattgaatctataaattaccttgggcagtatggccattttcatgatattgattcctcctacccatgagcatggaatgttcttccatttgtttgtatcctcttttatttccttgagcagtggtttgtggttctccttgaagaggtccttcgcgtcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgctaatcagctttaggagattttgggctgagacaatggggttttctagatatacaatcatgtcacctgcaaacaaggacaatttgacttcctcttttcctaattgaataccctttatttctttctcctgaaggagatccctggccagaacttccaacactatgttgaataggagtggtgagagagggcatccctgtcttgtgctgattttcaaaggaatgcttccagtttttgcccattcagtatgatattggctgtgggtttgtcatagatagttcttgttattttgagatatgtcccatcaatatctaatttattgagagtttttagcatgaagcgttgttgaattttgtcaaaggccttttctgcatctattgagataatcatgtggtttttgtctttggttctgtctatatgctggattacatttattgatttgcgtatattgaactagccttgcatccccgggatgaagaccacttgatcatggtggataagctttttgatgtgctgttggattcggtttgccagtattttattgaggatttttgtatcaatattaatcaaggatattggtctaaaattatcttttttggttgtgtctctgcctggctttggtatcaggatgatgctggcctcataaaatgagttagggaggattccctctttttctattgattggaatagtttcagaaggaatggtaccagttgctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcaaggaatttatccatttcttctagattttctagtttatttgcgcagaggtgtttgtagtattctctgatggtagtttgtatttctgtgggattggtggtgatatcccctttatcattttttattgtgtctatttgattcatctctctttttttctttattactcttgctagcagtctatcgattttgttgatcctttcaaaaaaccagctcctggattcattaattttttgacaggctttttgtgcctctatttccttcagttctcctctgattttagttatttcttgccttctgctagctttgaatgtgtttgctcttgcttttctagttcttttaattgtgatgttagggtgtcaattttggatctttcctgctttctcttgtgggcatttagtgctataaatttccctctacacactgctttgaatgtgtcccatagattctggtatgttgtgtctttgttctcgttggtttcaaagaacatctttatttctgccttcatttctttatgtacccagtagtcattcaggagcagtttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaattggtgtggtgtggtgctgaaaaaaatgtatattctgtcgatttggggtggagagttctgtaaatgtctattaggtccgcttggtgcagagctgagttcaattcctgggtatccttgttgactttccatctcgttgatctgtctaatgttgacagtggtgtgttaaagtctcccattattattgtgtgggagtctaagtctctttgtaggtcactccagacttgctttatgaatctgggtgctcctgtattgggtgcatatatatctaggatagttagctcttcttgttgaattgatccctttaccattatgtaatggccttctttgtctcttttgatctttgttggtttaaagtttgtttcatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttaaatgtgaatttgatcctgtcattatgatgttagctggttattttgcttgttagttgatgcagtttcttcctagtctcgatggtctttacattttggcatgattttgcagtggctggtaccagttgttcctttccatgtttagtgcttccttcaggagctcttttagggcaggcctggtggtgacaaaatctctcagcatttgcttatctgtaaaggattttatttctccttcacttatgaagcttagtttggctggatatgaaattctgggttgaaaattcttctctttaagaatgttgaatattggcccccactctcttctggcttgtagagtttctgctgagagatctgctattagtctgatgggcttccctttgtgggtaacccgacctttctctctggctgcccttaacattttttccttcatttcaactttggtgaatctgacaattatgtgtcttggagttgctcttctctaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgtagatttggtcttttcacatagtcccatatttcttggaggttttgttcatttctttttggtcttttttctctaaacttcccttctcgcttcatttcattcatttcatcttccatcactgataccctttcttccagatgatcacatcggctcctgaggcttctgtattcttcacgtagttctcgagccttggctttcagctccaccagctcctttaagcacttctctgtattggttattctacttatacatttgtctaaatttttttcaaatttttaacttctttgcctttggtttgaatttcctcctgtagcttggagtagtttgattgtctgaagccttcttttctcaactcgtcaaagtcattctccgtccagctttgttccgttgctggtgaggaactttgttcctttggaggaggagaggtgctctgcttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactctagaccctgtttgcctgggtatctgcagcagtggctgcagaacagcggattttcatgaaccgcgaatgctgctgtatgatggttcctctggaagttttgtctcagaggagtacccggccgtgtgaggtgtcagtctgcccctactgggtggtgcctcccagttaggctgctcgggggttggggtcagcgaccaacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcaggcccccctcccccagcctcgctgccgccttgcagtttgatctcagactgctatgctagcaatcagagagactccgtgggcataggaccctctgagccaggtgagcgatataatctcctggtgtgccgttttttaagcccgtgggaaaagcgcagtattagggtgggagtgacccgattttccaggtgccgtgtgtcacccctttctttgactaggaaagggaactccctgaccccttgtgcctcccaagtgaggcaatgccttcccctgctttggctcacgcacggtgcgctgcacccattgtcctgcacccactgtctggcactccctagtgagatgaacccagaacctcagatggaaatgcagaaatcacccgtcttctgcgtcgctcacgctgggagctgtagaccagagctgttccgatttggccatcttggctgccctctatgatatctattttttagttagtgctctgttgctttaaattaaggctcatcttcagttacagctgacttttactttttaagtaaaggggactctgaaaattgtttgtgtgtattgtttgcaatttacaaaacattccattatagaaaccgcataataattatggaataattgagacgaaagataatgggaatcttcctacaccattataggagcaactgtcctcaacaatagcctaagcccctgaaagaaaagtccctttttctcctgccataagcaccaactctatcattaatccacctaataaatattgttgtgtgtcaagcactttgtaggtattgaaaataaagctgtttacaatagaaactgaacattgtagtttagaggctggaggagattaataggaaagtaggcaagaatagatcagaaaactcatgattatgacaaatgctatattataaatatgcatcatctttaacatgatttctttttctttcagatagtaaaattggtccatttacatttgtttttgaattactaattagaaaagaacatatacattactaatatcttaaaacatatgcgttactaaaataattactaccttgtacatatacccattagtaatgtatagaacacatacattactaatatataaagaacaaatacattgctaatatattagaacttatttttgctatcttgcttgctttcttttttctgcttacatttccacatgcctctcaaacaccacgtctatatgggtttaagcacccacttaagatgacaaccattttaaattcttggagacaaaggatttacaaaattactttcttgcctatggtagcagggtgtaccgtatctttgcctgggaaatggcatttgacttaatgaggtttaagaccccttaatagtaccaaaaatactcaggttgttgcaaagtagccagaaagtcttccaaaatttcattagggactggagagtctcctagatctgcactcctcaaggactgccagagctctgttgacagtctcaaggattctttgctttcattctgcccttccctgtgttcaacatttccttcagaaattcgtggtttcctttaagaacacggatgtctaggaaacttccagttttgctgttttcaattcattaacaaatgtttcattgtttcgccatattgccatgtttttacttgttccctcctataaaagaactattcaactaatatttacttttttcttgactttttctattttaggaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattagtaagtgatttacatattcccattcagtttctgtcaacttcgttcctctctttgagatgatagtgttttacttaaaaatatagaaaacaattttaggagtaaagagatacaaatacttctaaaaccattcaacattctgtgccaaattaagtcttttgcatgtttagagtaatggctacttgggaagatgatcatttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgtatttttaacccaaatactgttgtataatttacatactcccaaatccacttcattttcaagggtacaattcaactatttttagtcatgagataatatggaaccttgatacataatacaacatggaagactctcaaaaatattaagctaagagagaaaaaagatacacttacaaagtgattatctcaatgttatcatgagttttgggggttatatgaattcctacatttctagaatactgttttcaatttctatacttatcaagggctctgtgtaaagaaaaaggtgtatacttcaattttactcagctttgataaatgatctactttaaaacttgtgaaataaaagacaggatgcttcataaattttatagaacttatatccaattaatataatttttatctaatatatacacccttactgttagtaaatcgttacataactacataaatggttacattaacttttaaattcacaaatttaaaagcggtttaagctccgtgacacattggactacgaatgctacgatggatatgaaatcagttatggaaacaccacaggttccatagtgtgtggtgaagatgggtagtcccatttcccaacatgttatagtaagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacgtaagttcttaaaattctagatcctgagaaaatcagagtaataagtttgatatttgcttttttatactagaatttttatgggttattaccctagaactgtgttcacaaacagctattctgctgaatgtttgcctttcagatcttaatatataagtgtataagcttggaaaattccatgtaaacaatgaccaagtttcttttttaaaacaggaatgtcggcctggggtggtggctcacgcctgtagtcccagcactttggaaggccgaggcaggcagaccatgaggtcaggagttcgagatcagcctgaccaacatggtgaaccccgtatctacaaaaaatacaaaaattagccaggcatgctggcatatgcctgtaatcccagctactcaggagggtgaggcaggagaatcatttgaacccgggaggcagaggttgcagtgagtggagattgcaccattgccctccagcctgggcgacagagggagaccccatctccaaaaataaaaaaataataaataaataaataaataaataaataaataaataaataaataaaacagaagaagaagaaaagaaaaagagaaaaagaaaaaaccaagaatgttcagagtcttcaatttgttaatggatacaatgagtcttcaagaatgacaaccatttattgcgcacatatgaaatatggcatctcagcttaacaccagtaatcattttcacattattaacacttaggtaaagagttttcaaacagttctgaaaacattgtttcaaaaaaccacaaactattaaaccctacttgaacacatgaaatttttcctgatagaacacatagctggttaacactgagaagttctttctctgattattattcttacttatattttatcagtattcctagcaagcaacaaagaaattaacgaaacttcagccatttccataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctccaaactatgcaagtggtaagactgaagaagaaattagtatcctcaaatcaaaatagtttacaagtatcttcaaacttgatttcatagaaaagtgttaggtttcagagataaattctgagtcttaaatttgattgactgaggagatggacactcctaagatgggtttcacagcaaaagcattacctcttctcacaatcaagaacaggaaaggattataattatctgaagatataagatcagttctatgatacaagcaagactttcagtcttcaaaactaaagaagcaaagagcattcaagcacagaattctagggaaaaaggcaaccttatggaaaagattacatatacatatggcatattaaagcaatgaggaaaattttcccaggcagcaggaaactttagaaagttttggaaaatatgtttggagaagtatttagagttcaaacaatatttatttttgaattgtaaacagcccctgaatgtattgaagagctcttaaaattttttggatttcaaaagtgatatgtactatgttaagaaatttatttaagtaagtacttgaaagatgtattaaaatatgattggggaaatttctaaagaaatgctaatgctaataagggctaaactagaatgcagaatacttgagtcaaaagaagagataggtgagtgaatgatatcatcaaaagtgaaaagcttgctatgtaagaactgacatttttatcatgtaagtactaggcttaatacctggggtatgggttgataggtacagcaaaccaccatggcacacatttacctatggaacaaacctgcacatcctgcacatgtaccctggaacttaaaaaaaaaattataaatttttttacaaaagaattttataaaagaaaatccatatgtggaagtaacattatcttactgattttacagatgaaggcatagtgagacagagtaatttgtccataatcatgtagggattcatattaactctgtgtgcttatccttgcctctctttaaaatagaaaatgaagatgacagggatagatgatgttgatagagagagagataactgatagatattgaggtatatttatgtatgtatgtatgtatgtatatatagtttcattttaacagatgactattagaaagattatacctttctacagttctgtttctacattgtgggcataagagaaaaatataaacatagaattaaattagcaaaatgtgagtacatttggagtgcttgtagtcacggcttgtcgaatgggggaaaggaggataagtaaccatgactccaatggaacatgttagcataatcctttttgatatgaagtcactagggtggacacaacatattttaggaaagaagagttcaggctctagagaaagactgccagggttcacgtttatcacctcacctgatgatctctgctgtgatgttggggaagtgcaactgaacttattatatttttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgtgaaaaaagaaaagaggttttgctaaccctttcagagcattgggaacacagccagaagtgcattaaatgtatatattaacttgggcaatgttgacactttaggatgctgaagccaggtgcagtggcacacgcctgtaatcctagcactttgagaggccaagctggcaatcatcagaggtcaaaagttcaagaccagcctgttcaacacggtgaaaccctgtctctactaaaaatagaaaaactagctcggcatgatggcgtgcacctgtagtcccagctactcaggaggctgaggtgggagaatcactttaaccagtggggcagaggttgaactgagccaagatagtgccactgcactccagcctgggcaatagagtgagactctgtcttaaaaataaataaataggatgctgaaaattcctatttaaggaaataattctttttctgatttatttaaggctacatttgtattttcttaatacaaatattttgaaagtttcttcatatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaattacctagtctcaagtatgtttttattagcagtgtgagaatcaactaatacagtaaattggtattacacagtagagtggggtgctgctgtaaagataaccaaaaatgtagagtgactttggaactgggtaacagacagaggttggaacagtttggaggactcagaagaaggcaggaagatgtggggaagtttggaacttcttagagagacttgttaaatggctttgaccaaaatgctgatagtgatttggaaaatgcaatctaggctgaggtggtctcagctagagatgagaaacttgttgggaacaggagcaaggtgattgtcgctatgttatagctcagagactggtggcattttgccacttccctagagatgtggaactttgaacttgagagatgatttaaggcatctggcggaaaaaatttctgagcagcaaagcattcaagagatgacttgggtgctgttaaaagcattcaattttatatattcacaaatatatggtttggaattggaaattatgttaaaagggaagcagagcataaaagttcagaaaatttgcagcctgatgatttgatagaaaagaaaaacccattttctggggagcaatttaagctggctgcagaaatttgcacaagtaatgagaaaccaaatgttaatcaccaagacaatggggaaaatgtctccagggcatgtcagaggtctccagggcatgtcagaggtcttcaggacaacccctcccatcacaggcccagaggcctaggagaaaaaaatggttttgtgagcagggcccaggaccatgctgctttttgcagtttcaggagttggtgccctgcatcccagcaggggctaaaaggggccaacatagagctcagaccattgctttggatggtgcaagccccaagccttggtagcttccatgtgatgttgagattttggttcacagaagtcaagaattaaggtttgggaacctctgcttagatttcaaaggatgtatggaaatgcctggatgtccagcaaatgtttgctgcaggggtggggccctcatggagaacctctgctatggcagtgcagaaggaaaatgtggggtgggagcccccacacagagtccccactggggcactgcttagtggagctgtgagaagaggcccactgtactccagaccccagaatggtagttccaccgacagttagcatcgtgcacctggaaaagatgcagacaatgccatcccatggaagcagtcaggagggaagctgtaccctgcaaagccacaggggtggagttgcctaagaccatgggaacccatctgctgcatcagcgtgacctggatgtgagacatggagtcaaatgagatcatttttgagctttaagatttgactgccctgctggattttgtacttgcatgagacctgtagcccctttgttttggccaatttctcccatttggaacaggtttacttacacattgtctgcaccattgtctgtaccattgtatctaggaaataactaatttgcttttgattttacaaagggacttgccttgtctcagatgagacttgagactgtggacttttgagttaatgctgaaatgagttaagactttgagaggcttttgggaaggcataattggttctgaaatgcaaggacatgatatttgggaggggccagggtggaatgatatagtttgactctgtgtctctgctcaaatcttaccccatgttaagggcagggccatgtggagataattgaatcatggggactatttccccatattgttctcatggtagtgagtaagtctcacaaggtctgatggttttataaatgggagttcccctgcacaagccctcttgcttgtcaccatgtaagatgtgactttgctcctcatttaccttccaccatgattgtgaggcctccccagccatgtggaactgtgagtcaattaaacctcttgttttaataaattacctagtctcaggtatgtctttattagcagcatgagaacagactaatatgattgccttagtttcctaaaatggtacaaaaataaatggcaggaaaccacaactgtaggagcaacaaacaatatcatcaggaagaggaaaataaaatgtgatataaaagcatcagtggggttattaaagagtagagtatgcacctagcaaagtgaattggtgtgacagataagaaatttggtgtagtgggttttaaaagggaaaccatagaggaatgattacagagattattaatctggagaataaaccataaaaatctaagtctagggaagaaaccagtacaattgcaataagtacaatcatcaaaatgttcttacattcctttctaaacaattattcctagtgtatagcttaatgtggttccaggcaaagtgagagataaaatctcacagaaacattatctagccaattgttttttaattataagactaatgaacaaatcttacaaatctttaggcaggaaaataaaaatgactgaaaatgaaatcttagggaaaatagaatggttgttatattaaaatgtaaatatacttggtgtgatatttatcaagcaaaatagctgtttatgggccagacatagtggatcaacctgtaatcccagcactttgggatgctgaggtgaaagggttgcttgaggtcaggagtttgtgatcagcctgggagtcacagcaagatcctgtgtataaaaacaaagaaaactaattagctgggcttggtggtgcatgcctgtagtcccagctactacaggaggatgaggtgggacaattgtgccactgcactccaacccagcgacagagccagtccctgtctcaaaacgaaaataaaacaaacccccccatttattagttcattaatttgtgcctagaaaccaattgttttaacacatccattaagaatcattatatgccaagccttttatctagataggaagcacattttgaatttgaaaatactattgcttgatatgaagttaattataacttctttgaagatacaatgcaaacacaaaattcagaatacaaaagtatgtagacagtatgttgttaacaataagggaagaaaatatagcggggagattggcaggaaaaacaagacattttgattttatcactttgaggtttcttctactttacagttattttatttatttatttatttttaattttgtgggtacacagtaggtatatatatttatggggtgtatgaggtattttgatacaggcatgcaatgtgagataagcacatcatggagaatagggtatccatcccctcaagcatttatcctttgagttacaaacaacccaattacactaagttatatttaaggtatactattaaattattgttgactatagtagccttattgtgctatcaattagtaggtcttattcattcttctaattatttatttgtacctattgaaaataggtacccacctcctctctgacacccccaaccactgcctcccaccactagccccttgctacagtagcccattcatctactgtctatgtccatgagttcaattgttcttatttgtagatcccacaaataagtgagaatatgtgaagtttgtctttctgtgcctggcttatttcacttaacataatgatctccagttccatccatgttgctataagtaactagatcttattcttttttatggcagaatactactccattgtatatacataccatgtatatacatggattttcttgatccattcatctgttgatggacacttaggctgcttacaaaccttagctattgtaaacagtgcagcaacaaacatagggatgcagatgtctcttccatatactgatttcctttcttttgggtatatgccctgcagtgggattgctggatcatatggtagctcaatgtttagttttctgaggaacctccaaactgttctccatagtggttatgctaacttgcattcccaccaacagtgtacaagtgttcccttttctccatatcctcccaagcatttattactgatttttggatataagccatattaattggagttagatgatatcacactgtagtttcgatttgcatttctctgataatcaatgatattgagtaccttttcatatgcttgtttgccatttatatgtctttgtttgagaaatgtctattcaaatcttttgcacgtttttaattggattattagaatctttcctatagcgttgtttgagctccttatatattgcggttattcatgccctgtcagatgggtacttcacgaatattttctcccgttctgtgggttgtcacttctctttgttgtttcttttactgtgcagaagaagatttttaactttatgtaatcccattggttcatttgtgtttaggtttcctgtgcttatgggatattgcccccaaaatttttgaacagacctatatcctggagattctctgcaatgttttcttgtagtagtttcatagtttgaggtcttagatttaagtctgtaatctacgttgatttttttttatatggtgagacatagggtctagttacattcttctgcatatgaacatcctgttttcccagcaccatttattgaaagacagtcttttccccagtgtacattcttggcactcttgtcagaaatgagttcactgtaggtgtgtggatttacttctgtgctctctattctgttccattggtctatgtgcctgtttttatgccactattatgctgttttgattactatagttgtgtagtataatttgaagtcaggtaatatgattcctctagttttgttcttattgcttaggatagctttggctattctgggtcttttgtggttccatataaattttagaattgttttttcctacgtctgtgaagaatgttattggtattttcacagtgattgcactgaatctgtagattgctttaggtagtatggacattttaacaatgttgattcttccaatccataaacataaaatatctttccatctttttgtatccttttcaatttctttcatcaggcttttatagttttcattatagagctctttaacttctttatttaattcctaggtatttaactttatttgtggctactgtaaatgggactactttcttgatttctttttcacattgttcactgttgacgtatagaaatgctactgatttctgtatgtttatttcatacccagcaaatttaccaaatttatcagttctaatagttttctggttgagtctttaggtttttccaaatataagatcatatcatctgcaaacaaggataacttggtttctttcttcccaacttggatgccctttgtattcttctcttgcctgattgctgtagctaggacttcgtgtattatgttgaataactatgtaacagtgggcatccttgtcatgttccagtcctttgaggaaaggatttcagtttttctccattcagtatgatactaactgtgtatctgttgaatacagcttttgttactttgaggtgtgttccttctatccccagtatttgagggttttcatcatgaaggatattgaattttatcgaatgctttttcagcatcaactgaaatgatcgtatggtttttatccttcattctgttaatatgatgtatcacattgattgacttgtgtatattgcaccatccttgcatcccacaggtaaaccccatttggtcatgatgaatgatctttctaatgtattgctgaattcagtttgctagtattttgttgaggatttttgtatcgatatttattagagattttaacctgtaattttctttctcttttttgggtgtgtctttgtctaattttggcatcagggtaatactggccccatatattccgccagcatctgccatacctcagtaccatatcagaaagaaggagcctagagtattattctgtttctctgggatgttctctcacatacatgcattccctcatcattggtcacactttttgccattttctgtttactatcaatcttaaccaagcttagcatctgtggatggaagtccataggtgagctataatacccacccatagagtgcagcaatagccccttgcatcaatagcctttccagaacttccctctatgaacattcccaataagaaaaagtacagttacaaatataaaatatggcaggagtatctctaccactagtcagggggcagcatctaggcagtcttagtttagtgagagaaataatcattcctcagcccgttgtccctttagtaatgtacacttaaattcagaggacttgaagtaatgttttcagctgcaatgacttcttgtggtaaaatctacagctgtaattctaaattggtaaaaatggatctggcaaaacagaaacagtttacggggttggaaatatgtacgagctgaccattcatgacatttgccataatccatgtgtctgtacatctgtaagcattgcctttgggataaccactcaattctttcaaacttccagatatattgctttcaatgttatttaccacgaatcttgccttgtaatctagattttattatctacaaggtgattgcttcactcaaattgggacgtgctgtcagaaaaacagacagattgctttgcacaaggagaagaagaatcacagagtttagaccatttcaaaaaaggagccagaagttcttttgtggattatatcattggtcaaaaatgctggctgcaaactgcttatgaatgtaacatacaccaagagcaaccaccagtggagagttgctgcatgtgtcatttccatattattagtttttctaaactgttccatgctaattggaatgtttgtctgatattacctatgaaataataggcattttgagttttagatttattaaccacaatggtgagggctatcttcatcaaagctcagtaatgaacaaggaattgtcttttaatccccctttaaaaattcacaaataataaccatacatatttatggggtgcatagtaatgtgtgtgtgtgtttgtgtgtgtgtgtgtgtgtgtgtgagtgtatatatatatatatacacacacatatatatacacacacatatatacacacacacatatatatacatatatatatacacatatatatataatgtatagtaatcagagtaattagcatctccattatctcaaacatttatcatttctttctgttgggaacactgaatattctccttccagctatttggtactatctagtatattcttggtaactgaaaaaaaattacatctaagtgttaacctcaggtatcttgaaatgccaactcctaacagtcatagcctgggagttcatgttagccttcttgcaactatgcatatccacataattaatcaaaatcatttgtgttttggtgagaattagcatctgcaatggtgagttttatgtgtcagcttagctaggctatcaatccaagttatttaatcaaatattaatctaagtgttgctgtgaacaaggtattttatagatggagttaataacatctacaataagttgcctttaagtaaagattacccttgataatatgggcgggtcacattcaatcaattgaagcagtaagagtcaaaacttcggcttcccaaagaagaaattctaccttaagactgtaacatcaactcttctctgagtttctactctattaacctgccctgtgaattttggacttgcttatactcacaaatcaagtaaaccaattgcataaaacaaatctctatctcatctatctatacacacctcacactatacattctgtttctctggaaaacactaatacatcatcttaccacttcacatttttaagcaattaaaatctctcactatcttcccaagatttggtattacttaatattcactagagaggctggtttgaccgattataaaattcccatttaacaagaataactaagaccaggtgaagagagcccttttccaaaatctgactataagtcggtaattgaattcactaccaaattacaaaccatttatttcaaggactctgtggaaagattaatctggcaggcaccgatacttctctgttttgcaaaacagaccacatatttaatgttatttctctagtattgatggtcatttggtctttaaatcctggcgcttggaaggtaggatctgttgatgaagggtcagagtgaaggagtgccatgatttaacctgtatctccccaagtctccatcaaaacctttgtcacacatgaagccaattatatttggttcagatatttatctcaatattgctggggttgaatgttcatttgctttactttccaccatgagatgttttaatatcaccaaacttgctagcagcaaccaagaaaatgtatttctagtaatttctccatcattttgtatcacattctaaatacatatatatatatatatatatatatatatatatatatatatatatatataaaacaaactcttgagtcaaagtcatatactccaaactacactcctacaattcattccagataatcttcctctgaggattttcccttcagacaaagagtggattggtaacaccctggcaataaacatttgtcatacccttcatcctatcctccttaaatttcatggtgcctttgccatatcatgaagaaggaaagaagctcagtgtccacttctgataccactctgccactcctacactgctaagctaacagcagtgatcttgctttcagaactagcaattcacatttttacctatcattatgttaactgctgaaaattatttaacacagcattaatgtcaacagcatagtgagaattgtgactcttatgtgtagtgtctgattatcctaatcttcaccttgaattcatatgtttaagggagatgactcaatgagtgtctgtgacctctgaagttcttccatctcctttcctttattagttgatgagctccctcagctgcatcttatgaaatccagttatttattatacttattttagatgaacaacctaaaaaatgtgatttgagcacttaactcagattcttatttatcttcaatctggtgtacacctaaagattctcttgcaagaattttaacaagggtcaaattatcagtcttctatgaaattacagaaaatatcacagacttgtttttaaaacttttcttaaagaaacaggcagaaaactgtcaaaaacatgggtgagcgctaccgaggtagagaaataaaacattactctttcattagatacaattaaactttgaaaacacatttaaatatgatttctaaaataggtaagacttggttacatttgatgacaccaataaagatgaactaggtaagtaatcataatggagtacattcttaaatgcaattatttttatgacacatacgtacctcagagtggagataaattaaaatattagtatgtaatgtatcatagttactatgttttgcagattaaagatgtccacaaataatttgaaaatcctctgattaagtgacctatttccccatcatcttgaacttgtgctaacccatgacttttctgaccaataggatatggtataagtatctctatgccagttacggatgtaagctttaaaaaaatagcagcttctgccttggtgtcttgtagcttctaatcagcatgagagaattctgggtaccctgtagagaggccctgagagtgacaggagtcacctaaaccccaaatttcacttgttgctggcaaagcaccaaatatgtgactgaagacatattgaaccctccaccgcagaagattaaccagatgaataacaatgaatgtctccattaatacacagaaaataaaagatttatccatttgatccccaccaaaattctatgccccatagaattgtgagatgtcattaaatggtatattagaaaagaagaaatatctcaaaacactaacctaagttccaacttaagaaggtaggaaatcatgaatattagtgtataaatcaatgaagcaagtgcaatatagaaaaaactgttttcttaatcttctcaaagaatgaataaaaccaatcaaagttagttctttgagaagaataaatgatatatttctagcaagaacaatgaagaaaaaaagaagaaacaaattacctgtcatttggcatagtatagggcattgactgacatggttccaatagttgaagggtatacaattattttaacttctgaaatgtccaaagtgtcagggttttgtctgaaaaacacaccaaaaaaaagagaatacccaaaagagttccattattaaatggaaattttatatgaaggaaaattctacaagaaggtacagcaatggccttggtcatattcatgagcaaatacctcctctttttctgggactcactctagagactgctgaagctctgtcttaggctactgaaggaaaagtttaaagggattctccattagaacacctgctgccagaggctagatgattatcctgtctttctgatggcagttcataaatgaatggttactactctacctggaaagttgtggcagatcctcatgggtaaatataagactaaaggaattcaatagggtaaactttaatgtgttttctcgctattatggaagacattgaggacataaaaggccagatcacatgggttgataccaattcatgaccagtgattaattaatgcaaaaatagttgattcaagtacttgttgcccgagatactacctttatgggaattaaaaagacaaatcaaactgggacaagctgatgcccaccaaaataaaaactctaccaggattggaaagcgactggagtcaacaaataggtatttcggttcattacctagaagtaactacttatatacatgaaaggaatggtcacagaaggacctaaaccaacagaagcaccagaaaaggtataaattgtttaccataatggtccagtttcttagcaagataggtaagatttaaaaattcattaggacatatccactggggtgatggcccagcatacagctagtaaatagattatatttgatgttcgttcttaacaccaggaagatttaagcaagctttgaaggccactaaaacgtatttgagacttggtttttttcatggaagttaaatctaacgtatgaaaattaaataatctgaattgtttttgcccaccaagttatattcttctgatcaaggaagctattttacagcacgtgatatacaacaatgggcaaataaacaccacatcgaatatatatatcatatcctttatcttctgcagagtagtggaaatatttgaaatcattaattgaaatacctgccaaaaataaagactggggcagataggtcagtaataaaggatgaaagagctggtttacttgttttcaagttgtgcattaaaattaaacatgagataatcatgtggttttgtttttagttctggtttctgtgatgaataacatttattgattcatgtttgttgagccaaccttgcaccacaggaataaagcctacttgattgtggtgtattagcgttttgatatgctgccagattcagtttgatcagattttgttgactatttttgcatctatgttcatcaaggatattgaccagaagttttccttttcagctgtgtctctgccaggttttggcattaggtgatgctggcctcatagaatgatttaggaaggagtccctcctcctcaattttttggaatagtttcagtaggaatgataccagctcttcctttcatatctggtagaatttgcctgtgaatccgtctggtcctgggcttttgctggttggtaggcttttaattactgattcaattttggaactcatttttgcttggcttggagattgaatctaaatgtccatcaacggtagattggatttttaagatgtggtacacatttaccatggaatactgtgcagccgtaaaatatagtgagataatgtcctttgcacgaacagagatggagctggaggccgttatctaagcaaactaacacaggaacagaaaaccaaataccgtatgttgtcacttataagtgaaagctaaacactgagtacatatggataccaagaagagaacaacagatacttgagggtggaggatgggaggagagtgaagatttaacaagccaccttttgagtactatgcttattacctaagtgacaaaataatttgcacaccaaacccctctgacatgccatttacctatgtagcaaacctgcacatgtgctcctgaatctaaaataaaagtaaaacataaaattaaaataaaaagttaaacatgggagaaaccaaagatgatttactattagataaatttcctagatagagtggtagaagtaagaacgatttggggatgaaaccggcacttatctacaagtcttttcaaacacagcacaattttcttcttttctgccttaccccataatttctgagtccagtttaaaatgaacagttcttgacacatcactcatatttaaacaggagttactgtctatagtttttaatttaaatgaattcagaagggattggtgggccagatgaaggactggcaaatgacagtcatggggaactgtggcctgctgcctatttttgtagggctctgactacaatggtttttacattttgacatctttttaaaattaaagtaagaaaaatcatttgataattaaaatattcataaaatttatatgaaatttacatatttgtgtccataaagttttattggaacacaaccatgttcactagtttacgtattccccatgttacactatcagggccaacagagtagttgcaacagagatcacagaagctagaatgtcccgtcctctcacctggcctaaccgggccttcaggtggaaatgctttgttaccaagtagaggtaacaggccagtaagtttgtacatttctaatcctatcccatgtgaatgaaaataaaccaagaaagaagccttagcaagattgttatttccagtgaataggttaactccatggtcaaacctgatatttctttttggagaggaaagtttgggttaaaataagtgatagataaaaagaaggtgacataattgcctaaataagagatctaacaaatatactatttaaagggaaaaatcaaacataactttgcttctagagagtcttacagcaaaaaaataattttctctcttaccttttagtctgatgtctgttacagtgaaataccttgtctcacaaagaccctactgagaggcgacagtgtgctggcagccctcgcagccttcactcgcttttggtgcctcctcggcctcggcacccactctggccgctattgaggagcccttcagcccactgcactgtgggagcccctttctgggctggctgaggccagagctggctccctcagcttgcggggaggtgtggagtgagaggcccggagggagagacatgggcaggaacccgggctgcccacagagcttgtgggccaggaggacttccaggtgggtgtgggatctgcaggcccacacttggaatggccggccagcacagccagcccgggcagtgaggggcttagcacccaggccagcagctgcagagggtgatccgggtcccccagcagtgccagcaggccagcgcagagctcgaactctcaccaggcctcagctgcctccctgtggggcagggcttgggacctgcagccagccatgcctgagccaccccgctgccatgggctcctgtgcagccagagcctccctgacgagcactgcccgctgctccgcagcgcccgttcccattaaccgcccaagggctgaggagtgcgggtgcagggtgcaggactggcaggcagctctgcctgcagccagctgtgggatccactaggtgaagccagctgggctcctgagtctagtggggacttggcgaacctttatgtctggctaagggattgtagatacaccaatcagcactgtgtgtccagctcaaggtttgtaaatgcaccaagcagcactctgtgtctggctccaggtttgtgaatgcaccaatcagcactctgtatgtggctaatctggtggggacttggagaacctttatgtctagctaagggattgtaaataaaccaatcagcactctgtgtctagctcaaggtaaacgcaccaatcagcaccctgtcaaaacagaccaatcagctctctgtaaaacagaccaatcagctttctgtaaaatggaccaatcagcaggatgtgcgtggggccagataagggataaacgcaggctgccccagccagcagtggcaaccctcgggggtccagttctacactgttctttccctctttgcaataaatcttgctgctgctcactctttggttccacactgcatttatgagctgtaacactcactgcagaggtctgcagcttcactcttgaggccagccagtgagaccacgaacccactaagaggaacgaacaactccagatgggaggaacgaacaactccagatgggaggaacgaacaacaccagacatcccaccttaagagctgtgacactcactgaaggtctgcagcttcactcctgaagccagtgagaccacgaacccaccagaaggaagaagctccaaacgtgtgaacatcagaaggaacaaactccagatgcatcacctttaagaactgtaacactcaccgcgagggtccgcggcttcattcttgaagtcagtgagaccaagaacccactaattccagacacactaccattactaaaacaaaatgccatggatctgggaagcagcaggcttgagcaacatcattactggagtgatgtatagcatatgcttcagtgaaacaaaggaaattcaggtttctcacacacacacatgctgatgtggtttgtatctgtagaaaaaatgcatcctgtatgacccagtggtggtaggacaaagaagtctgcgtgtgagttctatggatggatccctcaacgaacaaccctctcctactgctgctgtgccctttgcctgtgatacagcctttttgtgagcataagttgtttgagtcctgtgaattccttcagcaatccaacaccaacattcttaccacctggtaagactaaacaacttaatatatataaaagcaaataaaatacttctacatgaaaactatcccaataaatgtctatgtctttcattaaatactgcttcagtcattaaataatgtatatttgtaggagtacatctgcatctctgagtttcatctgcaaaatggagatgacatttttgaaatcagaatttaattcacaaatgtatgtaaataggttttagtatactgggcatttaacaatacttataaccatatagtaagtattcaataaatcgaagctactgttatcatttatattattcaaaggaaaacagagttggtcagtagaaacctactttttctttttgcatcagcctatgtaacaagaaattttttctcctgcaacttgatcacacaggtcagcagcagtgagttaaaggcagcttatagatataacagatacaaaatcccacatataaaaactataacaatataataagcacattaatagaaaaagatgaaagacactacaagaatttagacaaaaaataaacaccctcttggaggccaggaaatagatctgaaaggagatgatatttcatgtgaggttcaaacttgcatataattttggtaggtagatgcggagaaaatcaatacttaggagaaacagaatgtgaaagaccaacaacaagataaagaaaaaacataattgggaagtttcaaaaagttagcatgactaaaactcagggtattcactgtgatgagtgatgtgaggtatggaatcagaaaagattttaagattttatagacctgacaagaagactgaactttactcagagagtgatcagggagccatggatggattttaagcaagtgagatgcatagacagacggaccacggtttcatgagcgtggagactgaattacagtcaggaagtcaggagttaacaatatagaatgttcagataggagcagcactatttgagacatcagtttctaccgtgtgtgatttgtaatatccagtacaatatctatgcaaaatgaatttgacatttattgagacataagaaatactttttttaagtatcaggtttcttacttcataaaggtgaaatactaaaatatttgagaatacaaaaatgggcatttgtagccccaataaacatcaaattcaagaagaaaattaattggaaattccatgcaaatcatgtacaataaaaaattataatattaaaaactgattcaatttactgagaaaatcagtgatgttccagtagaaaggtacaggcataaataattcatacagttaaagcaaaatagtaaacaagtaaatggaaagtgttcaaaaaatgtaaatacttttgtaaaaaacagtagaatgttttattataaaattagtaagattaaatatttaagcctatacagttatggtagaaacagtttacatatacatagtttgagtcagcataaacagatatgtataggtttataaacaacatgctagggtttaaccagaacctaaaaaaatgcaccaatattttgtcttttccttcccactactcaaaatttacgtaaataactttttaaaatattatttacaaacaatttttctgcaacttcactataaccagaaaaactgagagcactcttattacccaaaaagaaatattaaattatatgacaggagttgtaaatacttaagcttacattaaaataaaatcatattaatggttttaaatataacatgaaatgtaaaatctctatactgttcttaaatgattttaaaactatccacaaatatgcaagaaaatagaaaatccttgagagtggttgacagacaaacaagaaagatactgaagtgtaaagcttgactgttttgggaacaaaaagttatcctgattgagttgaaaaaaggctgaagaaggaaatgaaggtgttttccattagcaaccattcataaattactttcagggcaccaaacatgatataaaacatctgagagcatttttagtaaacttgcacaattctgctatgagacatatttttctaaaatggtttggtcttgagcatcagtaggaagaatatgtcctgtaagtaaaggatgggatgtataggaaggactttatggagtacagctggagaatgctggagctcttagcaacggaggaagctatggattaggtaaactcttgcatgatcagcttacatgatccctggaggaaaatagcatgagtaggacatcacaacctgttctcatttctttgctcagttagtaggtaaaagtcaagtcattatccattaaaacttatcaactgatggaacacaatgggcaccgaaaacagagaacacaaaacaaataaaaaagatgaaaataaaatgtgttgaagtttgtaaaattatacaggattttagaaataaattaatgtttgtactttatatgtgcataaataaatcaattaaaagtttttcagttttttttgagacagggtctcactctgtgctgatgtcaattccctggtctcagttattgtacttgataatacatgggagggcataatctactgaaattacttaaaataagaaacagaaaaacaaaaggaaaatctaagtttccaaattagaagaatggaagaaatattcagcaaaaaaattggaaaataattgttgagtactgcttcaaaaaagaatagacaagagaagatactgttaattcaactaaaaattggcactagctctgtgaaaattaactctgtgctcataaataaatgataacatcccctagattcagacaagccagtatttaaatgtcagagagtttagaagaagccatcaaaacattgacatggtgaagcctttcagacagaagagaaaccaggagaatgtgttgttccatagaccatgtgaagcaggtatttcaaaatggaaggatgggaaactcatgtgaatttttgctgattattcagtttcaaccaatggatttgattacaaagaagatattgatgactgttacaagagaggtttaagtgtagtggtgggaatgaaaaaatgaaatgaggcagaaattgtagctaatacattggagtcattgtattataaaatgagaagagaattgggagcttactagaaagagatttggttccacaaaggattttttgagctttttttgttgttgttgctctttaagatggaagatgtttggtattttcgcatattggcagaaataatttgaaaaatggagaaattaatgataacagttgagagggaataattgaaagagcaaaatccttgcatagaaaagaggggatcaaatctggtagagaccataacaggataggagtaaggatcaacatccagtgaaacaggagacaatgcaaaaaaggatgtgtgtgaacagcaggtagttttcttctgattgcttctatatctagatgaaaaaaataaataaagtcattagcaaagtacaaggtgaggactgatggttaaggagggagataataaaacagaggaggagaaaggaagtgtcaaaatcatttaggcctatgatcattaatttaaagcaaggcaagtcagcaccgttgcatttggttttttttttcaactcttcataatgtaaacctttatttatttatttatctttattattatgctttaagttctagggtacatgtgcacaatgtgcaagtttgctacataggtataaatgtgccatgttggtttgctgcacccatcaactcgtcatttacattaggtatttatcctaatgctatcactccccctgccccccaccccatgataggccctggtgtgtgatgtcccccgccctgtgtctaagtgttctcattgttcaattcccacctatgaatgagaacatgcggtgtttggttttctgtccttgtgatagtttgctgggaatgatggtttccagtttcatccatgtcccttcaaaggacatgaactcatcctttttatggctgcatagtattccatggtgtatatgtgccacagtttcttaatccagtctaccactgatggacatttgggctagttccaagcctttgcaattgagaatagtgccatgataaacatacgtgtgcatgtgtctttatagtagcatgatttataatcctttgggtatatatacccagtaatgggatggctgggtcaaatggtatttctagttctagatccttgaggaattgccacactgtcttccacaatggttgaactaatttacactcctagcaacagtgtaaaagtgttcctatttgtccacatcctctccagcatttggtgtttcctgacttattaatggtcgccattctaaatggtgtgagatggtatctcattgccattttgatttgcatttctctgatgaccagtgatgatgagcattttttcatgtgtctgttggctgaataaatatcttcttttgagaagagtctgttcttatcctttgcccactttttgatgggtttgtttttttcttctaaatttgttaagttctttgtagattctggctatcagccgtttatcagatgggtagattgcaaaaattttctcccattctgtaggttgcccgttcaccctgatggtagtttcttttgctgtgcacaagttcttcagtgtaattagatcccatttgtctattttggcttttgttgccattgcttttggtgttttagtgatgaagtccttgcccgtgcctatgtcctgaatggtatggcttaggttttctttttgggtttttatggttttgggtctaacatttaagtctttaatccatcttgaattaatttttgtataaggtgtaaggaagggatccagtttcagctttctatatatggctagccagttttcccaacaccatttaagaaataggaaatcctttctccatttcttgtttttctcaggtttgtcaaagatcagatggttgtagatgtgtggtgttatttctgaggcctctgttctggtccattggtctatatctctgttttggtaccggtaccatgctgtaccatgctgttttggttactgtagcatagtttgaagtcaggtagcttgaagcctccagctttgttctttttgcttaggattgctttggtaatgagggctcttttttggttccatatgaactttaaagtagtttagtccaattctgtgaagaaagacattagtagcttgatgggaatggcattgaatctataaatcaccttgggcagtatggccattttcacaatattgattcttcctatccatgagcatgaaatgttcttccatttgtttgtgtccttttttatttcgttgagcagtggatcatagttctccatgaagaggtccgtccttcacatcccttgtaagttggattcctaggtattttattctccttgtagcaattgtgagtgagagttcactcatgatttgactttctgcttgtctgttattggtgtgtaggaaagcttgtgatttttgcacattgactttgtatcctgagactttgctgaagttgcttaccagcctaaggagattttgggctgagacgatggggttttctaaatacacaatcatgtcatctgcaaacagagacaatttgacttcctcttttcctaattgaataccctttatttctttctcttgacggaaatccccggccagaacttccaaaactatgttgaataggagtggtgagagaggacatccctgtcgtgtgtcagttttcaaagggaatgcttccagtttttgcccatttagaatgatattcgctgagggtttgtcataaatagctcttattattttgagatgcattccatcaatacctagttccccgagagtttttagcatgaagggctgttgaattttgttgaaggccttttctgcatctatcgagataatcatgtggtttttgtctttggttctgtttatgtggtggagtatgtgtattgatttgcatatgtttaaccagccttgcatcctagagatgaggccgacttgatcgtggtggataagctttttgatgtgctgctggattccgtttgccagtattttattgaggattttcgcatcaatgttcatcagggatattggtctaaaattctatttttttgttgtgtctctgccaggttttggtgtcaggatgatgttggcctcataaaatgagttagggaggagtcccgctttttgtattgattggaatagtttcagaaggaatggtaccagctcctctttgtacctttggtagaattcagctgtaaatccatctgctcctggactttttttggttggtaggacattaattattgcctcaatttcagaacctgttattggtctattcagacattcaaattcttcctggtttagtcttgggaggatgtatgtgttcaggaatttatccatttcttctagattgtctagtttatttgcatagaggtgtttatagtattctctgatggtagtttgtatttctgtgggatcggtggtgatatcccctttatcattttttattgcatctatttgattcctttctcttttcttctttattagtattgctaggggtatattaattttgttgattctttcaaattttcagcttttctgctctggtttctccccatctttgtggtttttacctacctttggtctttgatgttggtgaccttcagatggggttttggtgtggatgtcctttttgttgatgttgatgctattcctttctgtttgttagttttccttctaacaatcaggtccctcagctgcaggtctgttggattttgctggaggtccactccagaccctgtttcctgggtatcaccagcagaggctgtagaatagcaaatattgcagaacagcaaatattgctgcctgatccttcctctggaagctttgtcccagaggggcacttgcctgtatgaggtgtaagtcgtcgcctactgggaggttgtctcccagttaggctacataggggtcagggacccacttgaggaggcagtctgtctgttctcagagctcaaatgccatgctgggagaaccacctcactcttcagagctgtcagacagggacgtttaaagtttgctgccttttgtttagctatgccctgcccccagaggtggggtctacagaggcagcaggcctagctgtgctgcagtgggctccacccagttcaagctttcaggccactttgtttacctactcaagcctcagcaatagcggatgcccctccccccaccaggctgttgcctcacaggttgatctcagactgctgcactagcagtcagcaaggctccgtgggtgtgggacccaccgaaccaggagcaggagagtgtctcctggtctgccgtttactaagaccctcggaaaagtgcagtatttgggcaggaatgtcccatttttcccaggtgcagtctgccatggcttcccttggctaggaaagggaaatcccctgaccccttgcacttccagggtgaggcaatgccccgcccagtttcggctccccctccatgtgctgtacccactgtccaaccagtcccaatgagatgaaccaggtacctcaattggaaatacagaaatctcccatcctctgcgctggtcacgctgggagctgcagaccagagctgttcctattcagccatcttggagcggtgaccgcatttgtttttcttgtagacacactctgctgcttcagttcagagacagggcaggcagagaatttatttgcaaaggtttgaggttttctaaaacttggattacagatagaaagaaaggaatgggcaggagagtgtgtgcaagggattgacttacagtgatgaaccattgaatctaatttgggtatggtgggaagagagaaagtgaagggaaaagaatagtgaaaaagcatcagtgtcattgaatggttggaacaaatttagtagagtaagtgagctaaaaagattgttgaaatggtctagagtgtgacactttagataatttaggtagtttaattggaaatgataaggtttagatagactagaatcaatagtggagactagtagctcacagagacttctctggtttcttgattgaacatagctatatgcattcccattgacttctgaaccaccatcagtaagtttcatcttagtggaagtccttaggctgtccctttctccaaattttgccattaaatttttgactgactggccactttgttgcttgccccagctaatatcctctacacatactaatcttctctacttgcttcccactgtaacctctttatattcaataggatccttgggcagggaattttccacgctataaagtcactcccctccagtggagcagcagagtttccagtccacacagactgcttgcctacccagggttcaacttctgagccacagaactgagctgtgagacaaaggtggataaaagcatccactcttttttactgagatttatgtggactttctggaataaatatttcccaacagtatgctctttggccaatttctagagattatttttataattttatccagttttattgctgccttttggtggtgagtgaatataccaagacccagaaatacccattctcaaagtcccatcagaacaaaattattttgaagtaaaatttgttcaacaattttgggaaccattacataccaaaaattattcttgatttgactttttatagtctaaaaatatgaaaactattaagaagttacctcattcttttttttttttttttttttttgagacggagtctcgctctgtcaccctggctggaggggagtggtgcgatctcagctcactgcgaactccgcctcccgagttcacgccattctcctgcctcagcctcccaagtagctgggactacaggcacctaccaccacgcccagctaatttttgtattttcagtagagatggggtttcaccatgttagccaggatggtctgaagttacctcattcttaataccagttttaagtggaatttataactagaacagtgatgctgttatgttaagatgaggactgatcaccttcacttgcttgcctactgatgtagctgaactcttggctagaaaaaagaaggggcttcctctttcctcttcaatggcccatttctgaatattccaaactcagagactcagggaccacaacaaggaaattgaacagcttttattttgctcaagttaatattacatgataaactcagagtattattgtgaaaacactgattagacactatttgcttattttgcacaaccctccatgaactttgatgtttaccacaaaggactttactaaactagcttccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggtaagttcaaaacagacctgaatatttagttcctttttcagatacatttatcggtttttgtgtgtatgcttacatatttttaaatgaataaatggatgaaaatattttaaatgagttataatattaatctattttatggaaatactttctaacatgcaattagcaggaaaatagaataaaattagttctctccatcctctaagttgcaaaggtaaatggccaccaaatagagaatgtaaagaggaattaaatgagggaaaacctgctatactaacggtggcaaggtgaagtattagtgtaattctgcatacactctgcaatgccactaactagaacaatcaatctcaaaaagatttggccaccttcaaaatgctttttggattttagtttcctagatttgatcatttaaattttaaaggtcattaaaatggaggaattcccatttcaattgaattatccttcaacagagggaaatatattttactgaaacaatagaaaatatcatttatatataaaccagtgaactgtcaagaaattgcttcttctgagctcttaaatgttgagaatgaagtaatgtatcacctctttattaatactacaaactgcttcttatgatattttataaacggtcccattttatttcatgttgaaattaaggccaccatatcaaaggaattgcaaacaaaatctctaccaaggtctaggatactaattaaactatgtctgtacatggagtttcgatcattatgctttaccctttgatttccaaaaagtttttactttactgtttggctgtttcctaatgtttccagacctttgaacttttatttgaacagtttctcatcagtcctgacataacagaacaacatgaacaataacatgctttcctttaaatatttgcccttagaaatgttgcaaaatattatttctattgcttgaaattcatttttttttgagatggactttcactcttgtttcccaggctggagtgcaatggtgtgatttcggctcaccacaacttccatctcctgggttcaagcaattctcctgcgtcagcctcccaagtggctaggattacaggcatgcaccacgacgcctggctaattttgtatttttagtagagatggggtttctccatgttggtcaggctggtctcgaactcccgacctcaggtgatctgcccgcctcggcctcccacagtgttgggattgcaggcataagccaccacgcctggcccttgaaattcgttttattttgttttcacttttagtgctgagttgtaatcacaggagtgtgattgtatgagtgtatttgatttttcttaagtctgtgtttatggtatttattaagtggcttatacacctattacacatggcattacatgaggatttctaaataggggggtagcagaggaaaataagtgaaaaatatgagagaaatatgtagaattttgacaattcctaaccctcctcccaccaaaaaaaagttcaagcttcaatccagtctctgggagaaacttcagtgaaattctatctaaaggttgcctagatgttaaatgatctgtaagtgtgtgttacactgtcatttaggtgtctactgagagacctgccaaacagcaaaaacaacacactgaagcaacacatttgtatacatagaaagctgcatgcttccagtagcaaaatatttatcaagcactatgttgtgcttcatgtagcaaagaagctggaagaaaatgacaaccctaaccacacctcactgcaacttacagtgtcctaaagaaaagcaaaatgtaaataggcaaataaattgcaaggctatatataggtgactgtgagtgagtgtgtgtgtgtgtgtgtgtgtgtgtgtataaacagtcatgcatcacttaatgatagggacactttctgagaagtgcgtccttaggcgatttccttcttattcaaacattatagagtggacttacacaaacctaggttttatagcctactaggtaactaggccatatggtatagcctgtcgctcctaggctgcaaacctgtacagcatgttactgtactgaatactgtgggcaactgtagcacaattgtaagtatatgtttatctcaatatagaaaagtacaataaaaatacagtataaaatattaaaaacggcagacttgtatagggcttttaccatgaatagggtgtgcaggactgaaagttactctcagtaagtcattacatgagtggtgagtgaatgtgatggcttagaacatcaccatacactactagaggtggtataaacactgtatacttaggctaaactaatttattttatttatttatttacttgaatagttttgggggagcaggtggtttttggttacatggataagttcttcagtgctaattactgagcttttgatgcacccaggatagactaaatttattttaaacttttcttcgataataaattaaccttagtttatgttaacctttttacttcatcaactttaatttttgtgtctttcgagataatatttagcttaaaaaacattgtagagatgtacaaaagattttttctttctgttcttgtgctataagcttttatcttttaaatattttacttatttatttactttttaaacctttttgttaaaaacagacacaaacacacacattaacctcggcctacaaagagtcaggatcatcagtatcactgtcttcttcccccgctcttgtcccactggaaggtcttcacggcagtaacaggcatggagctgtcctctcctatgataacaaaggtttcttctagaatagttcctgaaggacctgcctcaggaaacattaactgttttacagttaatttttttaatcaatagaagaagttaactataaaatactaataacaattatactatatgaaatacattaaccagtaacacttctatattatcatcatcaagtattacgtactgtacaaaattgtgtgtggcatatttttatgtgactggcaatgctgtaggtttgtttacccccggcattgccacaaatatgtgagtaatatattgcactgcaatgttacgatggctattaggtgataggaatttttcagctacactataatcttatgggtccactgtcatataagtgatcagtcattgaccaaaatgtcattatgtggtgaataactgtacgactgtatatatatatatatatatgtgtgtgtgtgtgtgtgtgtgtgtgtgtgtgtatcccagaagaaatgtattcacaatattctatcaaaatattgagacaataaaaattattttctacttttgaaattggtggttgtgtaaaggaggcttgcaagaagacattaacactcctagctagcaccattgcagatatgcacaatgaatacttgatgaatgtcatagaattctttctgaagcataggtacaatataaatggttgatgaaaaccaagttattctggatagcaaagaatatgtaggtacaaatgtatgaaaataaactactataattttggaggagtgaaggataattgaaagagttatggtaggttaatactatcaagacgggagtctttccctcaacacctttaccaaaactatctaatgtcaaattttaaacagttagataatcaatttcaggtttcacaaggtgaaaatatttcaaatattgtgcaacattaaacattacttctagatagatgaaaaagagaaatttctcttgatttgtcagcttaatttctgcacacatctttcaaataaggtgaaaaataaaattatttcttatgcagcagtactatattgcaaaaatatcttgacataaaaacaaagagcagtattatattgaggaaatatcttgagctaaatacgtactcaaagataaagcatatcaaacccatagaacgtacaacatcaagagtgaaccccaacataaactatgaactttgggtggtaattatattgacagtgagggagcttatgcatgtggtagggaagaggaagtggtatataggaaatctctaccttccactcaatcttgctgtgaaaaacctgtaaataaagtataaagtctaataaaaaatatgtgtgtatatatatgtatgtgtacacaaaaaaagagtaaaaagtatgaagatttcacccattttctacattgttttaatatatcttgcaccatagtgtgtatggatgtatttatacatatatacagtagtcctttagcatcctcaaggaattggttccaggacgctacccacccccagcagataccaaaatccaaggatactcaagtgtctaagagagaatggtgtagtatttgtacataacctgtgcatatcctcccatacaatttattttattttattttaattttttttgaggtggagtcttgctctgtcgcccccaggctcgagtttagtggcatgatctccgctcactgcaacctccccctcctgggttcaagtgattcttctgcctcagcctcccaggtagctgggatcacaggcgtgcaccaccacacctggctaatttttgtatttttagtagagatggggtttcaccatgttggccaggctggtctcaaattcctgacctcaagtgacccactcacctcagcctcccaaagtgctgggattacaggcatgagctaccacactcagccctctcatacaatttaaggaatctctagagtatttataatacctaatacaatgtaaatgctgtaaaaatagttgttatattgtatctttaattgcattatttttattgttttattatctttattgtttttttcaaatatttttgatctgcagttggttgaatcagacgaagtgaaacgagtggggctgactgtatatatatatatatatatatatatatatatatgtgcgtgtgtgtgtgtgttcacaagtataaatatataaatacaaatatacaaatacatatttgtatatacaacattaaccagaatttagctctaactttatcttgattgagttgttcttagtgattttcttatattccctaaattatttccactgaaactatattaactttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagtgagtaaatgctctgttcattaaatggatgtcattcagtgaatagagaaggatatgccagacaagatcataaggtcttgataatcacagggacagtgaccaaagaagctggaaagatgggagatgtagtccccctattttgagatgcctcctataagaatcaatgaagaataaatatgtcaactgtcttgtgttacctggaaatgctctacgtgttgaaatatattaatttttttaaactgatctttaatatatttgactgctaatatttctttactaatattcatttcgcagcagcctgatcaaagttttccttttaaatgtcatttttatacatattctgttttgaatttaccattctttagcatattgaaaggaggtttagcattttcacttttatatttcaataaataatttctttggtccttcacagtgtagctatattaattctccaataaatgtagagagcagactccaatgataacaggtgtattaaaagaaaaaaaaattgggagacagatacatgaggcaacaaaggagatagcaatgatctttctcctaagaaacatttatgagagttaagagagaaatagatatatgaagaggttcttttgtccctaaaaggttgacaaacataaaatatttcattataaaaaccatagagcaagaaaatgaaatattttcttctatatatacatataaaagaaccaaaaatatgtttcatcatatatatagtagcatgagttaacttcttttgaaagtgtttatatttgatttcagctttgaaagctttcctttttaattttttttgttcgtttgtttgttttgttttgtttttgagccatctcaactcactgctacctctgccttctagattcaagtgattctcctgtctcagcctccagagtagctggaattataagtgcgcaccactatgcccgctaatttttgtatttttactagaaacagggtttcaccatgttggccaggcaggtctcgaactcctggcctcaagtgatccactcgcctcagcctcccaaagcgcagagattaccagagtgagccacttcacccggtttattaaaatattttaaaatgcagttgtactttttctttgctacttccatcttgtacattaatccgtttttggtccttaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactggtaagtacaatgctgttctctcatatgctgttatc

SEQ ID NO: 222 - DNA, 1580 bp, Homo sapiens
ggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagcccgcggcgcgggggtggccgctgcgcccccgccccgggaacggcccgaagcccgacgcggtccccgcgccggttccggcgggcggccgcaggcgtttgtttgttggttccgcgccgccttcctcgccgg

SEQ ID NO: 223 - DNA, 1862 bp, Homo sapiens
aaacagaagccatgtcttctacattttgatcactcaaacccttagatttttatctatgttatctgagttttaagcataagaaatgcaattgaatgtgcataaaatataaattatctaacttcctatcgaaatgttttgtaagctttccattgagattcatgattttttcattgaccactgcaatggacagaattatgtcctttcgaaattcatatgttgaaatcctaacccccaatgtgactgtatttggagaaaggcctttctttaaatgagtaactaaaattaaatgatgtcataatgaggggatgcctatccaataggaataatgcccttttaagaagaagagttactggagcactctctccacccttgcacagagagaaaaggccatgtgagaacagagaaggtgttgtctggaagccagggagaggacccttactagaagccaactttgctggtaccttgatcttgaacttcctaatctccagagctataagaaagtacatttgtgtgtctaagccacccagtctgttgtattttgttatggcagtctaagaagactaacacaactacagaaaaggtagatgctgtatgcgttacagaacaatcactaaaaatagaacaactgctaaaaagattctttggtcttttttatcaaaagtgagcaacaatgaagacttatattatcaacattgcttacatattggtagcacaaataatcttagatttctaggagtgtaaaaaattcccatttacaatagcagtggatcaaaaataattgctcatttacataataggtcttgtgtagttcttagatccttataaatttgatgtcctttcatcttatttttgttcgctatcatccctttatttaataattactaagtgtaaggtatgatatatattttaggtcttatatttataaatgacctatatcaatttaatagtaaatatatcattaactgtgatgaaattgtattcttttttaaatcaattctcagatatgctctatgaattcaatttactacaaacaagcatgtatatcttcacacaccatcaattcagatttgtttggaaatggaagaaaacatatacttcaaaattgatatggcttttttccttttattttttgcataggctttaattttattttttacggaacaatatgtgatattagctgctattttttgagcatgtattattggccaaattttacctatccatttgcttgaggttagtggttcatctacctcagacttgggtgttcagtctcttcctacttcagcttgctggtagatcaaccatgttgagttttaggtttaggctctttgccataaatgggaagtagttataataaaatatgttaagataatatttatctttttattgcaatgtgtaattcttattttgaatggagttcttttgaatttacaacatcattgcctctgcctacgtagcagtccttaaattttacatatatctgtaattgcccttattaacaggactcctcagtcatatacatttaatgataatagtcataaaagaagtgccttaggtacgtttgtattgattatcctctacaatgtaattaccaaatgaatcatactgaaatgagttaagagagtttttgtatgtagggttttgatcctaaatgtaggatacaggtgtgtaatataaggcagaattaaatcaagaaaactattaaatcccacctattaggtgcttcttcccattgctatgcagattacttatcttagttattttcctcagctgaaactctggttgtcaaaaggtatgcaaaattaagtgcaaaatatgtttaaaagattctgttgaatatttatatgaattagaagaagaga

SEQ ID NO: 224 - DNA, 14242 bp, Homo sapiens
agtcactttgaagaaaggaaatgaagcataccatcagcaattttcaaaagttctgagacatttttctacagtattgatataataaagatgaacacatttggaaaatgttctcaatattttcattgtgaagagtatttatttttgttgctggaacaaccagaagcaaatgtgggaagactgagaaagtgtgaaattttatttctccacgcaaagaatactttagataacaattactgtctcaactactagcttgagaactggtgtcctttttattacactgtgatatacctgtgtggagttgggtcaggctaatgaagactaaagataatgtcaaatatgtcctatgtcccctcccactttatattctctttgaccaccagcagctcatgctatgacccgattgggtctgtcctcactcagcgattctcctcaccccgatcctagtttaaaagatttcattgcctcattttctttgcatccagattttgctttgagtctgcaaaatgacagattattggctaatcccactgaatgaatttggttgaagatgacttcaattaagtcttcctcaggagatgtggattttcatgggtacttgaaaacacagcatcttgtctcaaataaactttgagtgacataattttagtcaacaggtctggtcagaggatgttgccatgggtagaacaccctcctccaaggactggttttggtgtgtccccaggcattatcagtagagcttatataggaaggtaaatagaagctcttaactgtccgcaagcctacttgagcattgcatttggggcttagaactttgtgaattttttgcttattccacctgatataatcttagcaactttggatgaaatgcatttaaggattgaatcaaaagacttcctaagtcgcataaagactgtttcagttatctgctagtaaaagtgaatagtgttccatatatagaactagtaaatgcatcagatgaagtagaaggatgcagagaccttcactgacccagggtttcagctctaggggcaaactcactctttgaaatgttgttaaaattaaaaataaaaagccagacacagactagttataaaataaaccaacttcagttatataaatctgacttccttttctaagaaagcagttattttctcagcacctgtgtattctactcttcagtacctgtacgctatttaatacaatttgaatatgtcaaattctaatatatttgtttctcttattttccaagccacagaagcaataaacaatgtagaagaaagtagaatagatattggtggtaggcaaactgaacatatcaataagttttggacaataacatttagaaaagctattgacatttttctgttctctaatgctgataagtaaacaattcctgcttacttatgggtagcctcagatacatgaatagcctcaagctgatgccctataccatgatgtcatcaacagctaagaatatttcaatatcataatcctatacacttgggatgaaaaaaactattttaggagtttacaaatttcattggcatcttttcatttttctttccatcttttgttaggaaaaaaatcaaaatatatcatttatctttgcaatgtttttcatatatcatatgatactgtgttttcccctcatagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtatttcacatttaagacttttttgtaaagtgtacttttgtatggtatatgctgctatttatatttctctaatttgatataagtacctacagtactagggtttttcataataattgaatatttttccacatttcttggcatgatacagttatatgaaagatatttagccactgggatgagaagatgaggaaaagatcaaaatccatgggatcaattctgaaaggaaactgaggaagtcagggctgcctttgagatggtcctgtccaaagagtcttcagcagagaaattttggtggattccattataagaaagtggtatatagagaggtttgatccttaatattctgtgtcacacacaaaagataactatgtgaagtgatatgatcatcagttcaactgtgataatcatttcacaatgtatacatataccaaaacattacagtctacactgttattatatgcaatttttgtcaactgtacttcaataaagctaaggggaaaaatgaaactaaatttttctgaattcaaatatgtagcatgtcattatagagtttgagcaattttttttagcttcaactatatcgctcatattcccagctataacaaatatttaagggaagacagaataacttggctggctttgaattgctggaatattaatattaagatacagttagaaaataaactctcaatagaatggaatacttagtctttctgatgaaatggatcttacttaatttcattgatttttgaggactggtattctcctttttaacatatttatttttatagagaaggtaagtccatcaatcataaattaatctttaaatttcatttaccttaaatatttagataacaacaaggcatggcatatgatattacagtatttttgagaacattagaacacacaagaaatccagttaccatttcagcacatcaaggtgtgttctctgcgtatagccaagcactcttagtgcagtatcaaatatggttttgtacaaaggttactaaattggatttcaggacacaggacattgattttcacttcagagtaccacttctctagacctcgaggttctcaaatccaaaatgagagatttggactagattatctatcattttttttttagcactaaagttacttccaagtttaatctgcttcatttatttgatcgctacacacaatcttccaatgggagtagtttaccttgagtgaatttttggatcaataagtgagactttaatcaagcccttatgatacacagtttctttcaagtgtcttaatttgagctttggtggaggtcatttaaagctctgagtatcttgcttaatatatacatatgttaatttactctgcaccttccctatgtcttgcaggtctaaaaagtattctttattgggtggaagcaacttgcttatctccaatgtgacagatgatgacagtggaatgtatacctgtgttgtcacatataaaaatgagaatattagtgcctctgcagagctcacagtcttgggtaagttagtggctggagatgagtttatattgtacctttcaaagtatatcaccgcgacattttaatgctcatcactgaattgattcctatgtttattagtgtgaaattgcaaagtcccaatactccacacatgtccttgctttgctctgattaattgcataggggttatatgcaatgtttgaatacttattaattaaaatccagatatattatgctttagtctaattattccagtgatacagctgaaaagtaccaaaaattattaatggcagatgtgttgaataataaatatgatattacaaaatatctgggaaaataaatgaaggaaaattgtacaaaatatttatccttgaggggaaaaaggcagatgttatttgagatgacagggtttctgacattaaattcagtatgttggtaagatttttttattaacatgggaatactgtgagtgttgaaagtgaaccattaaaataaagtatatgtaaggaaaagttgcatagcaagaatataatttaaacagatttaaggaggattgaggggttcattatattccaaaaggcagggttacccatgtgtcattgcaaacaaataattcttctacatggcagttattcaaacaaacacatatttttatcacttactccagatttattttaaccagttttatttgaattatgtagtttggagaaagtgccttaacatttggatttcagttgctttttttctgtaacaacaaccaaacattgaatcttaggaatttttcctctggaataaatctttttgccttttaaagaatctcagaaaaatcatagtctatttaaaagttattaagtaaaaatgaaaatatatcatatgctgattatatttgctaagttataccatgatattattccatccattttgctttttgtcttcaaaggttattcagaaaacactttcatctgtggacatggtaataatgtatatcatgggttagataatgacgttgcttgttctttgatcaaatcataaacattaaaccaggaatgggcaaaagacttaaaccctggatttagaggtagtattatactaactaaaatattagctgcctttaaaatggcacagtttaattgagtcatatttcatattttggtgaaacaaagaatagagaactttcacatttgtagtatcaaaattcagtaacacaaaatggttatgatggaaattgtattgtgctgtatattactgattataaggcagatttggttatggaatacgctagaatttacactggtcataggtaaagcattacttgcatgaggtcaaattttatttcaaattaatgcacattattttgacatgtaatggttcgttgatatctgagataaacatatgcaaatactgatttctggggataaactaaattagtctctatatatatacacacacacatatacatatgtgtgtgtatatatacatatacatacacacacacacatatacgtgtgtgtgtatatatacatatacatatatacacacacatacatatgtgtgtatatatacgtatacatatatatgtatatataaacgtatatgatatatacactatatatggatatatatacatatatatggatatatattttgtaatttacacaattcacaaagaaaaaatgccagtatgagtatgccaatacatatatatacacatatatacacacatatatgtgtatatacacgtatatacgtgtatatacacgtatatacgtgtatatacacgtatatacgtgtatatatgtgtatatatacgtatatatgtgtatatatgtgtatatatacgtatatataggtgtatatgtacatatacacatatatgcacatatatacttatatgtacatatacacatatatgcacatatatacttatatgtgtgtatatatgtattggcatactcatactggcattttttctttgtgaattgtgtaaattacaaaatagatgctgtttgatacatataaaactatccaaagatgcacaagaaaatatttaataattatttccactacaggcagtgcatttctatacctctgaagtgaatacttttggtatcttggcatgttttattccataaacttctcatatttcattgatgcacatatgcccacataaagtttggtagtggtatgacacttggatgcttctttgatttttccttaggccagatgattagtctctattacaatacctctagtgaaccttgactagtgttattatgtaaaaaatattgaaaataagcatccaaaaaatgctccacattactaatcattagagaaatgtaaatgaaaaccacaatgagaaccaccatctcacaccagtcagaatgtctattactaaaaggtcaaaaaataacagatattgccggggttgtggagaaaagagaaagagaatgtttatacactgcttgtgggaatgtgacttagttcagccattgtggaaagcagtgtggtgattcctcaaataacttaaagtagaattactatttgacccaacaatcctgttattaggtatatactcaacggaatgtaaatcattctaccataaagatacatacatgcgtatgttcattgcagaactattcacaatagtaaaggtatggaatcaacctaaatgccaatcagtggtagactgaataaagaaaatatggtaaatatacaccatggaatactatgcagccagataaataacaagatcatggcctttgctgcaacatggatggagccattatcttaagtaaactaatacaggagcagatcaaatatggcattttcctatttataagtggaagctaaacattgagtacacatggacacaaagatgcaaagtgtgtccttaggtacttgatgtttagtttccaatgtgggacactggggcctactgagagtggagggtgggagaaggaagagaaccaaaaaactatcgagcactatgcttattacctggatgacaaaataatctgtacaccaagccccagtgagatgcaacttatctatataacaaacctgtacttgtacccctgaatctaaaataaaagtttaaaaaattgacaacataaattaacgtaatataatacagttaatatgcattagtaatttaatctatgtgtacacatgtatgtaaaacatgtacatatgcacacatgtgcgtgcatatttatatgtgtatatatgtacatatatgtggatagatatacacatagatatattagaaacagcatttactgagttcaaaccatgtgagacatttatttgttacagtatcctctgtgggaagtacgtaggtcgagcccattagataacaaccctcttgccttctgtgcttctgtaccaagtgagaaacaagaacagcagtaaggcatagggtaagtcaaacatcaccttaatttgttgaagaagctgccgttgaccatggtttgcatctgcatgggaggcacatgcccatctggacatgggcagtgtctatattggcaggatgtcactcaggtgtcagcttgtcccactgcttggtggctggtggcaatggagagcacttgctctctttggtcaggcctgttcccaagagagaattgtaggtgaaaggagtctcttcaaacttccaggctcattaagttatctgtcatgtatcctgatccaggctcccctcaaaccaagaaaaagtgggtactggggagtggtgaggtcagaagtcattccctcgaggagctgcctctctagggaagaaaatatcagtattgaggcagaagtattcaacatccacaccccaaccttaggtgctacttttaatcccgttttacaaacgaaggcattttagcacagaaagataagtggctatcccaaggggggatccagatccaaatccaggcatccgaccaaagagtcttaggcatatgctttactgtctgccctgtctgctccacacattcctattcatcgttttttattatttatttttaatcttactgaaacagctataaaaaaaagcaggtttatgtgatgtaaataagaacaattttaaattttagtttggttaataattagtcacttacataaaataaaatacgtgaccgtaatgtaatgatcttgacaaagcagaaaggctgacaggggagcagggaagaaaggaatacaagctgttctttgaaaatgaggttaaaacaactgccatacttcgaatctgtagacacagaggcaggtgaaaagtgtactcaatatcgggtattgcttattttttttactgtaacttcttgtttattcaaagtggtgtgccgtttgtataatcagaaaaataaatgtggaggtataaaagttgacatgtttatggtttaaaaatgagataaataaaaatgttaaaactcagaaaatattgagattatgctaacatacacataatccaaagacctggactttgcaaacacacacacacacacacacacacacacacacacacacacacacactcacgtttgttttctccatataagtgaaatgtatgctatattgtatcctcattttcacttcaggataaatcatggcatctttctttgtgtgtgcctgtgcacatgtctatcttctccagttctaatttttttttctttttgagacagggtcttgctctgttgtggccttgagttcgtggtgtcagatgatcctccattctcagcctcccaagtatcttggaccaaatttggctatttattttttctttcttttctttttcttttctttttttcttcttttttgtagagacagggtctggttatattgcccaggctgatctcaaactcctgggctgaagtgatcctgccaccttggcctcccaaggttctgggattacaggcatgagccatcgcacccaaccttcagctttatattgtggaacattatcatgtttcttagttttaattaagcgaggtgtggtggcttgcacctgtagtcccagctactcaggaatctgaaggaaaggatcttttgagcctaggagctctagtccatcctggggaacatagcaagatcctgtatctacaaaaacaaaaacaacccactaagttaattatccttaagtatctttgtcatttatttgctcatatctgaaggaaaagtatcccagaaatacttaaaccctcactggcagagcaaaactttgcctcccttcagagtgcattttcccccacaattttgaatatctaaacattttataaaatggagtctccttgtaagtatttatattcctattaaattaagatttcattttatagttttcttggacatttgcattttacattttgtgaatttgctgtcttttttgaccttcatacatttattgaaacatttatccttattttattgattacagaaactctttatgtaagaataatattgactatgttgtgtatgcctttgcatttttacattttgcatatggcaccaaatctttttcttcatggttgctagcattgtcattagacttacatttttattctatgaaccatgctatctctaaaaatctggttatggattacatgttgaatgtttaaattagaagcatgattaatttctaaaaaatagtgatatgtttatattttgagttttcatggtcttggttctttttgtctgtttttaagggattttttttggtaattggacatattttaaaggtctctcatggactttatatcatttataactactctagaaggcataatttacttcaggatttggttgatatgctgttttaattattctaaaaggctccaaaaatgaatatttgtataatgtttgaaataatctttgactactctgatataaagttaggattatcctgcaggactgagtttatatgaaaaattgaatttattgccttcttaaaatggatgataagaaaagaactttattatcaatgttatttaaatttacttttcataatttttaagaatttaatcatatttgtattcttcataagataaaatcccacaagaaatccaagcttctgcttataaaactttaatcacgcattttattagactcttgttttgcctttcaacttgcagtcctttcttgtacttaactgtctgtgaatgtgaaccttcatgaactaacagacttttcaagtagaatatcattttatagactagaagaaaagacattttgttgccctcctcagtaattttacagagtgaatatacattaaatataatttgaagcttagcattttgtttccttcttataaaataaaaatggaaaattccataatcattaagctttttggagatatctttattagacaagattaatgacaaccttatttacaataaataaaatataaataagttcataggtattttctttatcatagccatttatggtagcatttctgacttacagtaatcatcgataaagtattggtggacaccttttgggtacaaggattgcactaggttctgggaagactacagaaacatctgaaacctggcttcagtgggcttcgtataattacaattcgtaaaatcagttggcctaatactgtctgaataaacttttatttaaaaaaagaaaaaacgaaaatgttatatgtaaacagggactctgggaagatatgaagagttggtagtctccactctcatagaaaacaaagcccgaagaggcaggggtgggaggagtcctaaagaagaaaatgtggaaggaggctcttggaatattgttgtcaactttttaatttaattttagccatgactacttgtattatttattttaaaacctaacttttataaaagaagtcaaaagtggtatttttccattcttatgttcaatacgtccagctttctggctcaaggattttaatctgactataattgtgaacatatccttttctgtatctgcccatccccaacttttacccagctccacacaggaagaaagacagtcctccataaatgttctagagatttgccactgctttgggtctagattgatcccatgtctgaatcagtgcagaaatgcataatttaaaaagtgatttgatcttttacaaagtgccaggctttggacaaaccttgtgtactgtccttacacacacaggtggagatgagtgggaactttactgaggatggtctcttcagtaggagccattaagttgaacatcagtgagaaaataaaaatatctttgaactttccagaaatggttctagaattccctttaaagcagttgtgtagcaacacaaaaaacttgtaattgccctctaggaatgtgttaagtagagttctctctatagagctgagcatgtccaccttacacagatgtgttcaataagcctgaagatgatagactcagaatatttatatatagatatagatatacatacacacgtatatttttgtatatgtgcatacatatacataaacatagtatatacatatatatgcaatacatgcacttactctctatttctaaagtttccctttaaacttattattttctttcaaatgcatatgattatctcaaccattaaatgaggttctgattctgcaaatagataatagactaagctattcagaaaggtctagaaaaatcatcttaaaagtgatttaagaagaggccaaataaagatatatgggtgaagttaaatacccctgttaaacattattgttttgtaagatagctggaaaagttcaccttaatagctcattgctcaaaatgctttggaaattttgaaacatatggctggatatacggtgagctaatgaatatagtttctagtcctagatatgcagctgaaccacagtgtgagtagaaaactagcaaccaactgttgagtgcctcttgtgtactaagcattccgccaagtagtctttgggcataagaagatatgacacagatccaagcctcaaggataggtagggaaaaagacaagaagcaggcaattgctaacaaggccgaagagctgttgagaaagaggaagacaagggaccctgaataaagaatgcaacaaagatgagagaatgggggagggagtggtgaggggagagtatgagaatgggggagggagtgttgaggggagagtatctgacaggaggtagtaaatgtgcaaaggtctggaaataagcgggatggggaacgggaagtgaattatgtgactaaagattgtgggtacaaaggaatctgatgctggatgggagaatccatataggtcttgagtattttgctcatgtggttagatttatcttaagggcagtggaaacatatggaaagatttctgattgtggcttgtgagctatttaattttagccagctatgtaaacctctaatcttcaattccttcattattttcttcatatttgtagagctttaggagctacaagtgcagttttgttacctggatatttcccatcatggtgaagtctgggcttttagtataacatcacctggatagtgtacatcgcacctattaagtaatttcttattcgtttgtaaaacaatgataattactttatcataggatttggtgtccgtttgagtgtgaaaagtagaggagagagattccagaataatcaggcacagctttgggtgttctgggaaataaagtaatataagatcccctcctagccttcatgagaagcctaaagccagttggaaagattaagctagctaaacaaaccaagacatcccaaatgtcacaaatattaaaatattctatgtactttttcatatccaattatcattatctataaaatgtacataacagcaactagtccctacgtagttctcatgaattatggcgcgattgatataacaatatctagtgatcaatataacagtatctagtgatcaatataacaatatctagtgatcaatataacaatatctagtgatacattgaaatttctttggcagtaatctctagaaacatagacatccctctgtgggaaaaagatgatgtccatttgtgatgtgttttatgtatttcacttttttctgtgcttctacaccttgctgttcatgctttcttcacagctagatagggagaaacttaaaaacagaagccatgtcttctacattttgatcactcaaacccttagatttttatctatgttatctgagttttaagcataagaaatgcaattgaatgtgcataaaatataaattatctaacttcctatcgaaatgttttgtaagctttccattgagattcatgattttttcattgaccactgcaatggacagaattatgtcctttcgaaattcatatgttgaaatcctaacccccaatgtgactgtatttggagaaaggcctttctttaaatgagtaactaaaattaaatgatgtcataatgaggggatgcctatccaataggaataatgcccttttaagaagaagagttactggagcactctctccacccttgcacagagagaaaaggccatgtgagaacagagaaggtgttgtctggaagccagggagaggacccttactagaagccaactttgctggtaccttgatcttgaacttcctaatctccagagctataagaaagtacatttgtgtgtctaagccacccagtctgttgtattttgttatggcagtctaagaagactaacacaactacagaaaaggtagatgctgtatgcgttacagaacaatcactaaaaatagaacaactgctaaaaagattctttggtcttttttatcaaaagtgagcaacaatgaagacttatattatcaacattgcttacatattggtagcacaaataatcttagatttctaggagtgtaaaaaattcccatttacaatagcagtggatcaaaaataattgctcatttacataataggtcttgtgtagttcttagatccttataaatttgatgtcctttcatcttatttttgttcgctatcatccctttatttaataattactaagtgtaaggtatgatatatattttaggtcttatatttataaatgacctatatcaatttaatagtaaatatatcattaactgtgatgaaattgtattcttttttaaatcaattctcagatatgctctatgaattcaatttactacaaacaagcatgtatatcttcacacaccatcaattcagatttgtttggaaatggaagaaaacatatacttcaaaattgatatggcttttttccttttattttttgcataggctttaattttattttttacggaacaatatgtgatattagctgctattttttgagcatgtattattggccaaattttacctatccatttgcttgaggttagtggttcatctacctcagacttgggtgttcagtctcttcctacttcagcttgctggtagatcaaccatgttgagttttaggtttaggctctttgccataaatgggaagtagttataataaaatatgttaagataatatttatctttttattgcaatgtgtaattcttattttgaatggagttcttttgaatttacaacatcattgcctctgcctacgtagcagtccttaaattttacatatatctgtaattgcccttattaacaggactcctcagtcatatacatttaatgataatagtcataaaagaagtgccttaggtacgtttgtattgattatcctctacaatgtaattaccaaatgaatcatactgaaatgagttaagagagtttttgtatgtagggttttgatcctaaatgtaggatacaggtgtgtaatataaggcagaattaaatcaagaaaactattaaatcccacctattaggtgcttcttcccattgctatgcagattacttatcttagttattttcctcagctgaaactctggttgtcaaaaggtatgcaaaattaagtgcaaaatatgtttaaaagattctgttgaatatttatatgaattagaagaagaga

SEQ ID NO: 225 - DNA, 2021 bp, Homo sapiens
agaaacagcatatttgttcaactgagatgcaagatactccctgatgtagtcttcatggtccagtctcttctcaaaatgtttgttacttctctttatggatgtgtaaaggtagtttggctcataagagctcatttaattcattcttctgactttaggcaatacagtgtttttgtttttgagatggagtctccctctctcacccaggctggagtgcagtggtgcaatcttggctcctgggttcaagtgcttctcccatctcagactcctgagtagctgggattacaggcgcatgccaccaggcccagctaatttttatatttttagtagagatggagttttgccatgctggccagcctggtctcgaactcctgatgtcacgtgatctgcccaccttggcctcccaaagtgttggaattacagatgtgagccaccatacccagccagcaatacagttttaattcatcttttttctgaaaaaaaaaaaaaaaaatctgtaagtaagatgctataaatgcacgccatgcatattttcccaacattgcaaatgcacatgaattaccattgttcttttgtgaagactaagaactatataatggtatgtaagcccacacacatacctaaatgcttgtatttttgtgaagggatgtagtgatagcaaaaaatctttgcctaatctccttgtacaaaaaaagtattgttcacaaaagcagtaaggatttaaaaaggaagatttattgtttttttttaaggaatcaatgaaacataaatttaaataattgaaaaatcatggtttatacttcaattatctccaaaaggcattttagtacaaattagaatctcctttttaacttctctttattcagacacatcatagaaggtttctttccttttggtcctctttgcttcaggtatttacctctggcatccctggaatctctgattccctttatttcaactgcttcttagaggggcataggatacctttttctaggccatgcaagaaatgtccagagaacactatgctctttgaataacagttaaatgtcctttctatgctggaatgcttttctttgtaggtaacttcacagaaatgtataaccctttatttctgtggtcagaagagtgtggagttccatggaggtggttgctgtcatatagaatcttaccacaatcacttcctgagtctatgctgcagctgacagcagctgtcttgcggtagagcctttgacagtgccagctataactctaatgtcctcagtttgccttccctttcacctgtgagcttactcagactgaaccctcagttttacctttaccctccactcctttgctagtcagacaaaacttggtgtccccagtttccctgttcactgggactttcttccccctcctcattgtctgcctgggcactggtgtcccagtggagtgtcaggggaagacatctccaggtgtgaactcctgatggagtcctcaccaggctgagtcatctacagttcacacgggtacattcccaagtctaggctgtgatataatgtactatgaactctcggtgaaacaggtgtctcctctgaagccataatcattcaaaaggaaatggcagtgatctgagtttcactgactcttgatgactttggagtattcagagttgaaaaaactgacccatactttatgattcaaaattgcctgtgagattagagaactgagctctgtcattcctctcatcctagcacttcctgcctcagccttactcacattgcttggacatttaaatgtcaactggtgccgtgccctttatttaaatgaaacaaatggatcaggcaggatatggtatcagttttctggctgtggtggcttaaaatgtggctatgaaaaatttgcaaaagaagcctaaattcagctaaaagccttagtgagagaagtaccatttcagttttcttattctaattagggaacatattgtgacattctttaagaagataaaactagaagcagatattcacacattaaacaatgaagttcaa

SEQ ID NO: 226 - DNA, 72 bp, Homo sapiens
cttactaatgttactgccgtttatgggggctctgaacaacaccacgttttactaacacatgcacagagtgtc

SEQ ID NO: 227 - DNA, 9191 bp, Homo sapiens
aaatcactttcgtggcatcacgagaatccactgtggaggtgtgagggccaggaggccctgagaagtggaggccctggccctaagaggccacagccacccacccacaccgccaggcacccccaggtgacagtggccctcagaggccgcagccacccgcccacaccgccaggcacccccaggtgacagtggccctcagaggccgcagccacccgcccacaccgccaggcacccccaggtgacagtggccctcagaggccgcagccacccgcccacacctccaggcacccccaggtgacagtggccctcagaggctgcagccacccgcccacaccgccaggcaccctcaggtgacagtggtgcccttgggctgctccagtctgtccatgacaggcaggggcaggaaaaccacccaatcagcaggtccccaagagaaaacactggtcggagtcgccagaaagcacgatgctagggtactgcacgtatgtgggcagcgcctctgccccaagcatccttcctccagcccagtcacactgtctgcctgaccaatcctgcacgctcctcactaccctgcccggataccccctctctgggaaacctgtgagccccaggttgctggagggcctctcctctgtgcactcgcggtgcggacccaggccacggacagtctcggcaagtccgttacacactgaaagaagacctaccactacctcgatacgagggaacacagcccagctcggtctgtgaagctagtagaaccctgatacccaaaccagatgaaaacaaaactacggactaatatccctcataaatacagacgcaaacatcctactcagcaacatggaaaaagagtcacacaccatgcatgacaagtggagttcactccagaggtggaaggctcgctcactatttaaaaatccattgggccgggcgcagtggctcacgcctgtgatcccagcactttcggaggctgaggcgggcggatcacctgaggtcgggagttcaagaccagcctgaccaacacggagaaaccccgtctcaactaaaaacacaaaaattagccgggtgtggtgggttatgcctgtaatcccagctgctcaggaagctgaggtaggagaatcatttgaacttgggaagtggaggttgcagtgagccgagatcacgccatttgcactccagcctgggcaataagtgcgaaactccgtctcaaaaaaaaaaaaaataccatcgatataatgcaccctatcaacaggctacagaagaaatacgacgtggtcaaaccaactgatgcagggggcatgtgacgaagttcaagacccacgcgtggtaaacacccaggaaatcggtaacggaggtgcctcctgagtgaggtgaggagacacccaggaaatcggtaacgggggtgcctcctgagtgaggtgaggagacacccaggaaatcggtaatgggggtgcctcctgagtgaggggaggagacacccaggaaatcagtaatggaggtgcctcctgagtgaggtgaggcacatctgcaggtgctcctccaaggccaggagcagggcaagggtgtccaccctcccactgtccccactgctatccagcatcaggctggccgggggccacaggcaggaaaaggaccagaaaggaagaaatataactctctgtatttgcaagcggcatgaccgttgatgcaggaaatctcagagaatctacgaaataaatcctgggactgtgagtgggttcagaaggcatgggaccgcagacagtcagggagctggcaatgggctcgcggaaactggcattcccgtgctaccaccacctacgactgctcagcaacaaggaaatgcttagctgtaaatttaacaaaacctgtatgggacttaaatgctaaaaaccacaaaacactgaagaaacaaactttgaagaatccaaataaatggagagacacattgtgttaatggacagaacagacagcagagtcaagacataaattctcccaaaattgaggtacatgtttcatgcaactcctaccgtaaatttcagggtttttttttttgtaggtaaagacaagattattctaaaacgtatatggaaaagcaaagtaacaaggatagctaaaacagcgctgaaatacgatgactagaaggaactgcatgcctgatttcgggacatcggacagctgtggtgcagcacgggcagtgggagacacacagaggaacagagaacagtgaacccaggaggtgccccatgttagcaatgtgattttttcaaaattttattttaggtttaggggtgcctgtgcaggtttgttatacaggtaaacttgtgtcatgggggtttgttgtatagattatttaatcacccaggtactgagcctagtacccagtagttatttttcaccttctctccctcctcccaccctccaccctccttttcctcctccctcctcccacctccaccctcaaattcactcctgtgtctgttgttcccttctttgtgctcatgagttctcatcattcagctcccacttatagtgagaacatgtggtatttggttttctgttcctgccttactttgctaaggataatggcctccagctccatccatgttcccagaagacatgatctcactctttttaatggctgcatagtattccatggtgtatatgtaccacattttcttcatccaatctgccattggtggcatttcagctggtgtcatgtctttgcgactgtgaacagtgctgggctggtgtcatgtctttgctattgtgaacagtgatgggctggtgtcatgtctttgtgactgtgaacagtgctaggctggtgtcatgtctttgctattgtgaacagtgctgggctggtgtcacgtctttgtgactgtgaacagtgctgggctggtgtcatgtctttgctattgtgaacagtgctgggctggtgtcatgtctttgtgactgtgaacagggctgcagtgcacatttgcatgcatgcatctttatggtggaaagatttatattcctctgagcgtaaacccagtaatggagcaatctgatttctgacaaagtttgtaaaggcaattccatggggacagaaatcttttcaacaaatgctgctggaacaacgggatgtccacaggaaaacaataaacctcgaaccaaagaagatttacagatggcaaataagcatggggccagacgcgcgacatcctttgacgtgagggagcgcccatgaaaatagcagtgaggcaccgcacacctgtcacgatagcccaaatccagagaccgacatcaccaaatgcgggtgaggatgtggagcaacaggaatgcactcatcgctgtgggaagtgactgcaaaatggcacagtcacttggaagtcagctggtggtttcttaccaaagttggcaaaatcctgccacaggattcagcaaatgtgccccttggtattcacccacatgaactcaaaatttaggttcacatgaaacctgcacacagatatttcgagcagttttattcataactgccacagattggaagcaaccaagatgcccttcagtaggggactggataactgtagtccatccagacagcacaagaaaggctctgtcatgccgtgaaaagacgtgagcaagtttaacagcattctgcgaagtgacaggtgccggctgaaaaggctgcacgctgtggggtcccaccgcatgacattctggaacaggtagcaccatggagccaggaaagggttccgtggtggtcagtggtggtggggagggagggatgaatgggtggtgcacagggcccttttggggcagtgaagctgctgcgtgtggtgctgtaacagtggatgcacagtggatattcatttatcaaaacccacagagcatgccataccaagaggggccccccataagctgcggacttcgggcggttgtgctgtggccatgtagggttcgggtgctcgtgctgtggccgtgcagggttcgggtgctcgtgctgtggccgtgcagggctcgggtgctcgtggtgtggccgtgcagggctcgggtgctcgtgctgtggccgtgcagggctcgggtgctcgtggtgtggccgtgtagggttcgggtgctcgtggtgtggccgtgtagggttcgggtgctcgtggtgtggccgtgtggggttcgggtgctcgtggtgtggccgtgtagggtcatcactgttgtaaatgcactattcagggtgcagggtgttgataatgggggaggccgtgcatgtgtgtcaggagggtgtacatgcaaactccatcatctgctcaattttgctgtgaacctaatattactcttaaaaaaaagtctattaaaaaaaatccgataggggaagatggcggctgctcctttggaggagcgggattgagaggatcggggtggggagaccaaacaagagagacatttctggctctgaaggcgaacgcttcgctggccatttaggagctctgctcaaagccagacggccaagcgtggtggctcatgcctgtagtcccatcactttgggaggctgaggcaggagtatctcttgagcctaggagatggagaccggccggggcagcatgtcgaaaccctgtctctactaaaaataaaaaaaattagccaggcgtggtggcatgcgcctgtagtccaagctattctggaggctgaggtgaaaggattgcttgagcctgggaggcggaggctgcagtgagccgagatcacaccactgcactccagcctgggtgacagagtgagaccctgtctcaaaaaaaaattttttttagcaaaccagtaatagaaaggatttacttcagtctgataaagggcatctacaaaaaatctgtagttatgtcatacttaatagtaaaggagaaatgcctcctccctaaagtttggaacagtacaataaggcaagaaaaagaaatgaaaaggcttttagaacagaaaggaagatgcggagccgaagctggactgtactgctgccatctcggctcactgcaacctccctgcctgattctcctgcctcagcctgccgagtgcctgccattgcaggtgcgcgccgccacgcctgactggttttggtggagacggggtttcgctgtgttggccgggccggtctccagcccctaaccgcgagtgatcccgccaacctcagcctcccgaggtgccgggattgcagacggagtctcgttcactcagtgctcaatggtgcccaggctggagtgcagtggcgtgaatctcggctcactacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccctgtctgagaagtgaggagcctctccgcccggcagccaccccatctgggaagtgaggagcatctccgcccggcagccaccccgtccgggagggaggtgggggggggtcaaccccccgcccggccagccgccccatctgggagggaggtggggggtcagcccccccgaccggccagccgtgccatccgggagggaggtgggggggtcagccccccacctggccagccatgccgtccgggagggaggtgggggggtcagccccccgcccggccagccaccccgtccgggaggtgaggggtgcctctgcccggccgcccctactgggaagtgaggggcccctcagcccggccagccaccccgtccgggagggagatgggggggtcagccccccaacccggccagccgccccgtccgggagggaggtgggggggtaagccccccgcctggccagccgccccgtccgggagggaggtgggggggtcagccctccgcccggccagccgccccgtccgggaggtgaggggcgcctctgcccggccgcccctactgggaagtgaggagcccctctgcccggccagccgccccgtccgggagggaggtgggggggtcagccccccgcctggccagccgccctgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcctggccagccgccctgtccgggagggaggtcggggggtcagccctccgcccggccagccgccccgtctgggaggtgaggggcgcctctgcccggccgcccctactgcgaagtgaggagcccctctgcccggccagccgccccgtccgggagggaggtgggggtgtcggccccccgcccggccagccgccccgtccgggagggaggtggggggggtcagcccccctgcccggccagctgccccgtccgggaggtgaggggcgcctctgcccggccgcccctactgggaagtgaggagcccctctgcccggccagccgccccgtccgggagggaggtgggggtgtcagccccccgcccggccagctgccccgtccgggagggaggtggggggggtcagcccccccgcccggccagccgccccgtccaggaggtgaggggcgcctctgcccggccgcccctactgggaagtgaggagcccctctgcccggccagccgccccgtccgggagggaggtgggggtgtcagccccccgcccggccagccgccccgtccgggagggaggtgggggggggggtcagcccccccgcccggccagccgccccgtccgggaggtgaggggcgcctctgcccggccgcccctactgggaagtgaggagcccctctgcccggccagccgccccgtccgggagggaggtgggggggtgtcagcccccccgcccggccagccgccccgtccgggaggtgaggggcgcctctgcccggccgcccctactgggaagtgaggagcccctctgcccggccactaccccgtctgggaggtgtgcccaacagctcattgagaacgggccaggatgacaatggcggctttgtggaatagaaaggcaggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggctgcagggtcctctgcctaggaaaaccagagacctttgttcacttgtttatctgctgaccttccctccactattgtcccatgacccagccaaatccccctctgtgagaaacacccaagaattatcaataaaaaaataaatttaaaaaaaaaaaaaaaaaaaaatccaggctgggcatgctggcacatacctgtattcccagctgcttgggaggctgaggtgggaggattgcttgaggccaggagtttgagaccagcctgggcaacacagtgagaccccccatctctgcaaaaaaactttaaaaattagacaagcatggtggcacgcacctgtactcccaggtactcaggaggctgaggagtgaggattgcttgagcctgggagttcaaggctacagtgagctatgattgcaccactgcattccagcctgcatgacagagtgagaccctgtctcaaaaacaaaaaacaaaaccaaaacaacaacctaaacctcacaaaaaatgaactcaaatagatcatctatttaaatgtcaaatgtaaaactataaaactttgataagaaaatgtaggagaaaatgtttgggacctgggagtcattgaggaattcttaaccatgacaccaaaagcagatccttaaaattaaaaagaacaaaaaaaaaaaaaaggataaattagacttcaccaaaattaaaaagaaaacagccttttctctgcaaaaccctcattaagaggatgtaagagataagctatggactgggacaaaatatgtacaaaccacacatacacaaaagcctagcgtctagaacacataaacaacgagaaggcgcagctcggagcagggctgggaggatgagcaaaggcagacgtgccggctgcagccgcgctccgtgagtgagtggctgctgcatgccgggcctccagctgacagtgcctcccggggtcaacccgaagccagaggctcggcagtatgctggagacccatcctgggcacctcccacgttccctgtgggaacagctgcttctgcagaacatggaaaaggtccaggctggaagctgtgcagacggaatttaggaagagggaatggagagactgcaggagggagggaggcccctgcacggcaaggtggtggccacatgctccagaataggacttgggctccgcactgcagggaacgggacctgggctccgcgctgcggggaaggggacctgggctccgcgctgcggggaaggggacctgggctccgcgctgcggggaaggggacctggggtccgcgctgcggggaagggggcctggggtccgcgctgcggggaagggggcctggggtccgcgctgcaggggaacgggacctggggtccgcgctgcggggaacgggacctggggtccgcgctgcggggaaggggacctgggctctgcccagggactccacaattccttactaatgttactgccgtttatgggggctctgaacaacaccacgttttactaacacatgcacagagtgtc

SEQ ID NO: 228 - DNA, 10306 bp, Homo sapiens
gctgaggctgtaataatactgaggagaaaagttaagggtaggctgtttttctgagatttaaaatggttgggggaggaaggaaatcagcgaaacagcaccacaggcggctcctgggcagagaccagagacctgcagggagggcagagtggtccgggggggcagagacctgcagggagggcagagtggtccgggggggcagagacctgcagggagggcagagtggtccgggggaccagagacctgcagggagggcagagtggtccgggggggcagagacctgcagggagggcagagtggtccggggcggcagagacctgcagggagggcagagtggtccggggcggcagagacctgcagggagggcagagtggtccggggcggcagagacctgcagggagggcagagtggtccggggcggcagagacctgcagggagggcagagtggtccgggggggcagagacctgcagggagggcagagtggtccggggcggcagagacctgcagggagggcagagtggtccggggcggcagagacctgcagggagggcagagtggtccggggcggcagagacctgcagggagggcagagtggtccggggcggcagagacctgcagggagggcagagtggtccaggtgcggggggcggccagcaaacaccacccggggaacgggccgagagtgcggggtggctgcgaggacgtgccgagggggtgagagcaacctggtcaccaaaccttccccaggtaatgagaattcgccttcgaaacctgggcccaggcaccccaagaccatgtggaacattctgagtcattcaaaaaagacataactatgtctgacgcattcttttaattaactgccctgctcaggtggtcagtgggccccacttcccagacacaccacgccccagagaatgcagggtagatgggccccagatccagagaactgctcccggcccacggggctgccccaacacgtccctcgcactcggcccgcctgaaaataaagtctctgaaatggaacctggggctgaggatgaagccccccgcaggtggatctgctgttggccagagcagagaaggtgccgtggaggcctcggcgaggctcctgtctgccaaatcactttcgtggcatcacgagaatccactgtggaggtgtgagggccaggaggccctgagaagtggaggccctggccctaagaggccacagccacccacccacaccgccaggcacccccaggtgacagtggccctcagaggccgcagccacccgcccacaccgccaggcacccccaggtgacagtggccctcagaggccgcagccacccgcccacaccgccaggcacccccaggtgacagtggccctcagaggccgcagccacccgcccacacctccaggcacccccaggtgacagtggccctcagaggctgcagccacccgcccacaccgccaggcaccctcaggtgacagtggtgcccttgggctgctccagtctgtccatgacaggcaggggcaggaaaaccacccaatcagcaggtccccaagagaaaacactggtcggagtcgccagaaagcacgatgctagggtactgcacgtatgtgggcagcgcctctgccccaagcatccttcctccagcccagtcacactgtctgcctgaccaatcctgcacgctcctcactaccctgcccggataccccctctctgggaaacctgtgagccccaggttgctggagggcctctcctctgtgcactcgcggtgcggacccaggccacggacagtctcggcaagtccgttacacactgaaagaagacctaccactacctcgatacgagggaacacagcccagctcggtctgtgaagctagtagaaccctgatacccaaaccagatgaaaacaaaactacggactaatatccctcataaatacagacgcaaacatcctactcagcaacatggaaaaagagtcacacaccatgcatgacaagtggagttcactccagaggtggaaggctcgctcactatttaaaaatccattgggccgggcgcagtggctcacgcctgtgatcccagcactttcggaggctgaggcgggcggatcacctgaggtcgggagttcaagaccagcctgaccaacacggagaaaccccgtctcaactaaaaacacaaaaattagccgggtgtggtgggttatgcctgtaatcccagctgctcaggaagctgaggtaggagaatcatttgaacttgggaagtggaggttgcagtgagccgagatcacgccatttgcactccagcctgggcaataagtgcgaaactccgtctcaaaaaaaaaaaaaataccatcgatataatgcaccctatcaacaggctacagaagaaatacgacgtggtcaaaccaactgatgcagggggcatgtgacgaagttcaagacccacgcgtggtaaacacccaggaaatcggtaacggaggtgcctcctgagtgaggtgaggagacacccaggaaatcggtaacgggggtgcctcctgagtgaggtgaggagacacccaggaaatcggtaatgggggtgcctcctgagtgaggggaggagacacccaggaaatcagtaatggaggtgcctcctgagtgaggtgaggcacatctgcaggtgctcctccaaggccaggagcagggcaagggtgtccaccctcccactgtccccactgctatccagcatcaggctggccgggggccacaggcaggaaaaggaccagaaaggaagaaatataactctctgtatttgcaagcggcatgaccgttgatgcaggaaatctcagagaatctacgaaataaatcctgggactgtgagtgggttcagaaggcatgggaccgcagacagtcagggagctggcaatgggctcgcggaaactggcattcccgtgctaccaccacctacgactgctcagcaacaaggaaatgcttagctgtaaatttaacaaaacctgtatgggacttaaatgctaaaaaccacaaaacactgaagaaacaaactttgaagaatccaaataaatggagagacacattgtgttaatggacagaacagacagcagagtcaagacataaattctcccaaaattgaggtacatgtttcatgcaactcctaccgtaaatttcagggtttttttttttgtaggtaaagacaagattattctaaaacgtatatggaaaagcaaagtaacaaggatagctaaaacagcgctgaaatacgatgactagaaggaactgcatgcctgatttcgggacatcggacagctgtggtgcagcacgggcagtgggagacacacagaggaacagagaacagtgaacccaggaggtgccccatgttagcaatgtgattttttcaaaattttattttaggtttaggggtgcctgtgcaggtttgttatacaggtaaacttgtgtcatgggggtttgttgtatagattatttaatcacccaggtactgagcctagtacccagtagttatttttcaccttctctccctcctcccaccctccaccctccttttcctcctccctcctcccacctccaccctcaaattcactcctgtgtctgttgttcccttctttgtgctcatgagttctcatcattcagctcccacttatagtgagaacatgtggtatttggttttctgttcctgccttactttgctaaggataatggcctccagctccatccatgttcccagaagacatgatctcactctttttaatggctgcatagtattccatggtgtatatgtaccacattttcttcatccaatctgccattggtggcatttcagctggtgtcatgtctttgcgactgtgaacagtgctgggctggtgtcatgtctttgctattgtgaacagtgatgggctggtgtcatgtctttgtgactgtgaacagtgctaggctggtgtcatgtctttgctattgtgaacagtgctgggctggtgtcacgtctttgtgactgtgaacagtgctgggctggtgtcatgtctttgctattgtgaacagtgctgggctggtgtcatgtctttgtgactgtgaacagggctgcagtgcacatttgcatgcatgcatctttatggtggaaagatttatattcctctgagcgtaaacccagtaatggagcaatctgatttctgacaaagtttgtaaaggcaattccatggggacagaaatcttttcaacaaatgctgctggaacaacgggatgtccacaggaaaacaataaacctcgaaccaaagaagatttacagatggcaaataagcatggggccagacgcgcgacatcctttgacgtgagggagcgcccatgaaaatagcagtgaggcaccgcacacctgtcacgatagcccaaatccagagaccgacatcaccaaatgcgggtgaggatgtggagcaacaggaatgcactcatcgctgtgggaagtgactgcaaaatggcacagtcacttggaagtcagctggtggtttcttaccaaagttggcaaaatcctgccacaggattcagcaaatgtgccccttggtattcacccacatgaactcaaaatttaggttcacatgaaacctgcacacagatatttcgagcagttttattcataactgccacagattggaagcaaccaagatgcccttcagtaggggactggataactgtagtccatccagacagcacaagaaaggctctgtcatgccgtgaaaagacgtgagcaagtttaacagcattctgcgaagtgacaggtgccggctgaaaaggctgcacgctgtggggtcccaccgcatgacattctggaacaggtagcaccatggagccaggaaagggttccgtggtggtcagtggtggtggggagggagggatgaatgggtggtgcacagggcccttttggggcagtgaagctgctgcgtgtggtgctgtaacagtggatgcacagtggatattcatttatcaaaacccacagagcatgccataccaagaggggccccccataagctgcggacttcgggcggttgtgctgtggccatgtagggttcgggtgctcgtgctgtggccgtgcagggttcgggtgctcgtgctgtggccgtgcagggctcgggtgctcgtggtgtggccgtgcagggctcgggtgctcgtgctgtggccgtgcagggctcgggtgctcgtggtgtggccgtgtagggttcgggtgctcgtggtgtggccgtgtagggttcgggtgctcgtggtgtggccgtgtggggttcgggtgctcgtggtgtggccgtgtagggtcatcactgttgtaaatgcactattcagggtgcagggtgttgataatgggggaggccgtgcatgtgtgtcaggagggtgtacatgcaaactccatcatctgctcaattttgctgtgaacctaatattactcttaaaaaaaagtctattaaaaaaaatccgataggggaagatggcggctgctcctttggaggagcgggattgagaggatcggggtggggagaccaaacaagagagacatttctggctctgaaggcgaacgcttcgctggccatttaggagctctgctcaaagccagacggccaagcgtggtggctcatgcctgtagtcccatcactttgggaggctgaggcaggagtatctcttgagcctaggagatggagaccggccggggcagcatgtcgaaaccctgtctctactaaaaataaaaaaaattagccaggcgtggtggcatgcgcctgtagtccaagctattctggaggctgaggtgaaaggattgcttgagcctgggaggcggaggctgcagtgagccgagatcacaccactgcactccagcctgggtgacagagtgagaccctgtctcaaaaaaaaattttttttagcaaaccagtaatagaaaggatttacttcagtctgataaagggcatctacaaaaaatctgtagttatgtcatacttaatagtaaaggagaaatgcctcctccctaaagtttggaacagtacaataaggcaagaaaaagaaatgaaaaggcttttagaacagaaaggaagatgcggagccgaagctggactgtactgctgccatctcggctcactgcaacctccctgcctgattctcctgcctcagcctgccgagtgcctgccattgcaggtgcgcgccgccacgcctgactggttttggtggagacggggtttcgctgtgttggccgggccggtctccagcccctaaccgcgagtgatcccgccaacctcagcctcccgaggtgccgggattgcagacggagtctcgttcactcagtgctcaatggtgcccaggctggagtgcagtggcgtgaatctcggctcactacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccctgtctgagaagtgaggagcctctccgcccggcagccaccccatctgggaagtgaggagcatctccgcccggcagccaccccgtccgggagggaggtgggggggggtcaaccccccgcccggccagccgccccatctgggagggaggtggggggtcagcccccccgaccggccagccgtgccatccgggagggaggtgggggggtcagccccccacctggccagccatgccgtccgggagggaggtgggggggtcagccccccgcccggccagccaccccgtccgggaggtgaggggtgcctctgcccggccgcccctactgggaagtgaggggcccctcagcccggccagccaccccgtccgggagggagatgggggggtcagccccccaacccggccagccgccccgtccgggagggaggtgggggggtaagccccccgcctggccagccgccccgtccgggagggaggtgggggggtcagccctccgcccggccagccgccccgtccgggaggtgaggggcgcctctgcccggccgcccctactgggaagtgaggagcccctctgcccggccagccgccccgtccgggagggaggtgggggggtcagccccccgcctggccagccgccctgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcctggccagccgccctgtccgggagggaggtcggggggtcagccctccgcccggccagccgccccgtctgggaggtgaggggcgcctctgcccggccgcccctactgcgaagtgaggagcccctctgcccggccagccgccccgtccgggagggaggtgggggtgtcggccccccgcccggccagccgccccgtccgggagggaggtggggggggtcagcccccctgcccggccagctgccccgtccgggaggtgaggggcgcctctgcccggccgcccctactgggaagtgaggagcccctctgcccggccagccgccccgtccgggagggaggtgggggtgtcagccccccgcccggccagctgccccgtccgggagggaggtggggggggtcagcccccccgcccggccagccgccccgtccaggaggtgaggggcgcctctgcccggccgcccctactgggaagtgaggagcccctctgcccggccagccgccccgtccgggagggaggtgggggtgtcagccccccgcccggccagccgccccgtccgggagggaggtgggggggggggtcagcccccccgcccggccagccgccccgtccgggaggtgaggggcgcctctgcccggccgcccctactgggaagtgaggagcccctctgcccggccagccgccccgtccgggagggaggtgggggggtgtcagcccccccgcccggccagccgccccgtccgggaggtgaggggcgcctctgcccggccgcccctactgggaagtgaggagcccctctgcccggccactaccccgtctgggaggtgtgcccaacagctcattgagaacgggccaggatgacaatggcggctttgtggaatagaaaggcaggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggctgcagggtcctctgcctaggaaaaccagagacctttgttcacttgtttatctgctgaccttccctccactattgtcccatgacccagccaaatccccctctgtgagaaacacccaagaattatcaataaaaaaataaatttaaaaaaaaaaaaaaaaaaaaatccaggctgggcatgctggcacatacctgtattcccagctgcttgggaggctgaggtgggaggattgcttgaggccaggagtttgagaccagcctgggcaacacagtgagaccccccatctctgcaaaaaaactttaaaaattagacaagcatggtggcacgcacctgtactcccaggtactcaggaggctgaggagtgaggattgcttgagcctgggagttcaaggctacagtgagctatgattgcaccactgcattccagcctgcatgacagagtgagaccctgtctcaaaaacaaaaaacaaaaccaaaacaacaacctaaacctcacaaaaaatgaactcaaatagatcatctatttaaatgtcaaatgtaaaactataaaactttgataagaaaatgtaggagaaaatgtttgggacctgggagtcattgaggaattcttaaccatgacaccaaaagcagatccttaaaattaaaaagaacaaaaaaaaaaaaaaggataaattagacttcaccaaaattaaaaagaaaacagccttttctctgcaaaaccctcattaagaggatgtaagagataagctatggactgggacaaaatatgtacaaaccacacatacacaaaagcctagcgtctagaacacataaacaacgagaaggcgcagctcggagcagggctgggaggatgagcaaaggcagacgtgccggctgcagccgcgctccgtgagtgagtggctgctgcatgccgggcctccagctgacagtgcctcccggggtcaacccgaagccagaggctcggcagtatgctggagacccatcctgggcacctcccacgttccctgtgggaacagctgcttctgcagaacatggaaaaggtccaggctggaagctgtgcagacggaatttaggaagagggaatggagagactgcaggagggagggaggcccctgcacggcaaggtggtggccacatgctccagaataggacttgggctccgcactgcagggaacgggacctgggctccgcgctgcggggaaggggacctgggctccgcgctgcggggaaggggacctgggctccgcgctgcggggaaggggacctggggtccgcgctgcggggaagggggcctggggtccgcgctgcggggaagggggcctggggtccgcgctgcaggggaacgggacctggggtccgcgctgcggggaacgggacctggggtccgcgctgcggggaaggggacctgggctctgcccagggactccacaattccttactaatgttactgccgtttatgggggctctgaacaacaccacgttttactaacacatgcacagagtgtc

SEQ ID NO: 229 - DNA, 9348 bp, Homo sapiens
ggattttgaacttctagaagcccaaaaaacagcctatgacaataacaatcacatgaacaattcaacagtacactgaatgcattttaggcttttccaacagcctcttggtggatcccaaaccattttgggaagtaggtggcacagaagttattatttccattttgcagaagacaaattattctcaaatcagaaactggctcaaggaaatgaagctagacagtggtcaactccaaaggagagcccagagacaatgactccctctctgtgttaagaagctcacaccacctgtgctcctctgtgctgtccccaaactcaatcctgtcaattcatgctaggccctgtgttccctctgggcctctacacattcttaaggggacaggactctagggaaggcaggtgagacatcagcacaggcacaaaggcttccttccgattgacaacgagcacgccaaagccagaaaacaagtgacttctgtgacttccgtcagtttacactaagagggaaggtcactgactatggtcttgggtgatgtgacctatggacaattgtaataaaagtggtaccattgcctgctggaaaaggtaggtatgggagaaactgcctgtgggaaaatgatctttgactattttcccctctggatgttgaaactgtcttccaaataactgaattttgttgtgcccccagggtcacatggagccctggtttaagttcttgcgatgtcccatcctcatgaatacatttgtagctgtcttaagcaaagtgaaacaagagcatctttaaggccttcccagtccctccctaattttccttgtgcctctcctctctcctttgctgagcctttgcagctcagagcaccctcacaacctcccttcaacaggagcaccctctctctcctgccaccgcggatctattacatggcacatcctacactgggattgcagagctcagcaagactctgtccccaaagagcccatgctcttgtcaggaaaaagtcattatggaacagggttgggggcacagtgttgggggagccagagtgctggggacacaaggaaaggcaaacgatggacgctatgcaggcatggggtgagatgagagatgtttcccgtaaagatgccctggagctgggtgctaacgggcgggcagaagccggccaggtgaaaagaatggggcagaaactgggggacagaggaggaaagggaggagaaacatgtggatgggggtacagctgcctcccagcaagtcagagcacagggtccccccagcacttcctgggttactagggtgatggcaggtgaatacagaatagcagggccttggaatgtctgccgtattataaggttttttgtttttgtttttgtttttgtttgcaggtaaaatatcctctgcctagtcttcccaggatggagggtgttgcagattgaatggtctctcctccagattaatatgtagatgtcccaactcgcaataactcagaatgtgaggtttttggaaactgggtggttcgcaggtataattaattacgttagaatgagatcatcatgcagtagggtgggcttctagtccattattaccaaggtccttataaaaaggggaaatctgggccaggcacagtggctcaggcctgtaatctcagcactttgggaggctgaggagggtggatcacctgaggtcggaaattggagacctgcttggccaacatggtaaaactccgtctctattaaaaatacaaaaaaaaatagctgggcatggtgatgcacacctgtagtcccagctactcaggaggcggaggcacaagaaccgattgaactcaggaggcggaggttgtggtgagccaagattgtaccactgcactccagcctgggcaacagagtgagactctgtcacgaaaaaaaaaaaaaaaaaaaaaaaaaagttgggggtggggaatttgaacagattttttgtggaaaaaaaaatctgaaaagacatacacacagcacagtgttagaggtcaaaacaatataatgtatagggatatccacattttagctaagtacaactcaaaggaatgaatttaaaagatcaagttcaactcaagaaagacagtcctggtgatgttttcatctgagaaactcagtatctccctcagactgaggcaaaagggactccgaggccaggcctcacagacgggccccttctcatgaggcaaggatcacaggtcatgggatgtgaccacactctggatacccagccctctggaattctccatccaaagtagtggaatccccactccactgacagggcctgcatagtcctcttccctgggtccattcccctgtgggagaccaagccattggtgtacactgagggtccaaacaggtccaccttctggcaagcaggtctcctgatgtgcaagctgcagctggagacaggaagagaatgggactggctggggccatttctccctgggcggccacatccaacaaaactccagggaggctgaaaatttgaacctggtttcccaggtccctatgaagatgtctttgtcagagtaggagacaatatgaaaaagagtactcatatatgtactacacattatatgcacatatactatatatatactatatacatactatacacacatactatatatatatagagagagagaatatatatagagagagattatatatataatatatatagagagatataatatatatatagagagagagagagaaagaatatatatatagagagagagagggagagagatctatctaaatgcaatctgttaatttgactcatgacttaaaattttctagacatatgacatataagactccatttgtacttttgctcccagctctgcaaatattaggggcgggtctggagggcctatgccctcagcttcacgtggccagtgcacaacaactgagagaaacaggtgtcaattttcagagtaacttgtttcctggaaactgttgctcaccacactctatgcccctggtcaggcgttctcaccagggagagaagggtgatttgaggttgaaacagggaaagaggacaggagacaaaggaaataagtggcaaacacttccaaccctaaactttttttctttctttcttttctttctttttttttgctctgtcacccaggctggagtgcagtggcacgatcatagctcactgcagcttcaacctcctgggctcaagcaatcctctcatctcagcctcccaagtagctgggaccacaggcacacaccaccatacccagctaatttttttattttttgttgaggcaaggtcttgccctgtttttgtagaggtgaggtcagttgccctggctggtctcaaactcctgagctcaagcaatcctcttacctcagcctcccaaagtgccgggattataggcatgagccactgtgcctggtcctaaactttcaaatgcctgaaacacatataaaggaaaagctgggacaaggcaggaagaggtgagtccaaaagcgttcaactcagtgcctgccccaagacaaaatggaagaaaaatcaacaaataccgtgagaactctctctgtggatgaaaactactttcattgcaatcagggttaaagagaagtccttctaggtcacccaactttgaccttgaggcatgagtcttcttactcccatctctcttacccagagtgccaggagccagattttagggtaaatatccaagtagcaggttctgaagtaaactgtctcagtagcctgtatcttccatctccttcagtgggctttccagacattggttccgtgcatcaatctctctaaactcatctggcaacagcagccaggcacaaaccctgcagtctttaaagtggcacaaattcacagactgagagatgttcccacgctgcatatgttcctaaaacaaccccgtccaagccatccatccacttgcctccctccaagccacaaagtagtttcatgagctccatttcagttctgagatcaccaacacctgatatcattactcagagtcactggctggagaacagacatcatttctttcccgttaaacattgctcaataatcccaaatagggggcactgcagagctgaagcttagaggtgaatggtaaattctaataagaaagtgcagaaacatccaggatcattaatgctgcattagctccacttcttgccacactggtgctatgttttgtctttctggactggccacagaattttctagtgctttgaaaaatacagtgctgtttcttgcagctaaatggaaacctgtagagagcaaacaagcgtagatccttgaacttggtaatgaatagatgggattctaggtgagaaagaacgaagaagagaaaaacaccaagtctccatattcagaaaaattttttcaatgccaaagttgtattcaatttaaaataaaagcacaaaaaaacataaaattcccttttatacataaaccagtgatatggtttggatttgggttcccacccaaatctcatatcaaactgtaatacccaatgttggaggaggggcccggtgggaggtgactggatcatagggtggacttcccccttgctgttgtcatgatagtgaatatgttctcatgaaatctcattgtttaaaagtgtgtagcaccttccccttcactctctctctctcctgctccaccatgtgaagacatgcctgcttacccttttgccttctgccatgactgaaggtttcctgaggcctccccagccatgctacctgtacagcctgcagaactgtgagccaattaaatctcttttctttataattacccagtctcaggtagttctttatagcaatgcgagaatggactaatatagtaaattggtaccgggagtggggacattactataaagatacctgaaaatgtggacgtgactttggaactgggtaaaaggcagaggttggaacagtttgaagggcttaaaggaagacaggaagatgagggaaagttgggaacttcctagagactttttaaatttttgtgaccaaaatgctgatagtgatacggacaatgaagtccaggctgaagtggtcttagatggaggaactttttgggaactgaagtaaaggtcacttgctatgcctgagcaaagagactgctgacattgggcccctgctctcgtgacctgtggatctgtgaatttgagagtgataaattagggtatctagcagaagaaatttctaagcagcaaggcattaaagatgtggcctggctgcttccaacagcatatggtcatatgtgtgagcaaaacgatgatctgaaacttgaacttatatttaaaagggaagcagagcaaaaagtttagaaactttgcagcctgaccatgcagtagaaaagagaaacccattttctagggaaaagttcaagccagctgcagaaatatacataagtaaagaggggccgaatgttaatagccaagacaacagggaaaatgcctcaaaggcatttcagagacctttgtggaagccccttccatcataggcctggaggcctaggagggaagaatggttttgcagaccagactcagggccctgttgccctgcacaacattgggacactgctccctgcatcccagccactccagttccaggtatggctaaaagggccccagatacatctcaggccactgttccagagggtgcaagccataaaccttggtggcttccacgtggtggtaagcttttgggtgttcagaaggcaagagctgaagcttgggagcctcaacctagatttcagaggatgtatggaaatgcctggatatacaggcagaagtgtgctgcaggggtggagccctcatggagaacctcaactagggcagtgcagaggagagtgtggcatttgaacccccatacagagttcccactagggcactgcctagtagagctgtgagaagaggtcactgttcttccaatcccagaatggtagatccactgacaagttccaccatgtgcctggaaaagccataggcactcaacatgagcctggaaaagcagccaagaggctgtaccgcgcagagccaaaggggcggagatgtccaaggccctgggattccaccccttgcatcagtgtggactggatgtgagacatggagttagagattattttggagctttaagatttaatgactgccctgctgggttttggatttgcccctttgttttggctgatttctgccttttggaatggggagtatttagccaatgcctgtaccatcactgtatcttagaagtaactgactgggtttgattttacaggctcataggtggaagtcacttgccttgtctcagatgagaatttgtactgtggacttttgagttaaagctggaatgagttaagactttggggactgttgggaaggcataattgtattttaaaatgtgagaaggacatgagatttgggaggggccagggatggaatgatatggtttggatttgtgtccccacccaaatcccatatcaaactgtaatccccagtgttggaggaaaggcctggtgagaggtgactggatcacgagggtggacttcccccttgctgttatcatgatagtgaatatgttctcatgagacctggttgtttaaaagtgtgtagcacctcccccttcactctcttcctctttctctggccatgtaagatgtgcctccttcctcttcaccttccaccatgattttaagttttctgaggcttcctcagccatgattcctgtacagcctgtggaactgtgagccaattaaacctcttttccttataaattacccggtctcaggtagttctttacagcaatgtgagaatggactaatacagctggatttcctttagggaagggcttattaaaacctgattttttctaagctaattggaactatactttctttcagaacaagggagagaccctttagaaaagggttaaaatcaggagtctgtagatccaggctgtttataaacttcctgacattttatataatatatcataattatgcatatcacaggaagttagagaaagattccttaagcttgattggatatacatggcgatcgtaacccccaaagtaagaactactattgtggacacttaacttacaacaaggtatgataaacacgtgaagaatgctcactgctattagtcatcagggaaatgcaaatcaaaaccacaaagaactaccacttacaaccactaggatggctataataaaaaaaagcagataataacaagtgttggtgaagatgtagagaaacggaaccctcctatattgctgataggaatgaaaaatggtgcatcactttggaaaacagtcttacattttcctcaaaagggcaaatatggagttaccaaatgacccagcaattccactactaagtttagacccaagagaaatgaaaatgccgttatacaaaaacttgtacatgaaagtacagagcagcactattcataatagtccaacagtagatataacccaaatgcttattaactgatgaatggatgaacaaaatgtggtatagacatataatggaatattatttgacaacaaaaggaaatgaaatactgatacatggatgaattttaaaaacactgtgctaattaaaagcagtcagatacaacaggccacatactatatgatttcatttatatgaaatgttcagaatagccaaattcatagagacaaaagtagatgagtggttgcctagggtttgtgggggaggagctggagggaaatggaggataattgctaatgggtaggggtttcttctggggtaatgaaaatgttctaaaatttatagtggtggttgcacaattttgtgaatattctaaaaatcattaaactgtacacttcaaatgggtgaattgtaggctgtgtgagttacattttgataaagctgttattaaaagaaaaaagaaaagaatatgtgagcctattctccatctaagtggcccactcctctaccccaggtggggagacaccaggaaggctttgggaagggaccaacaggggtgcatggaaaacatgagtttgatatgaaggaaaaatgctattgccttcagccatctcattctcacccttggatacagatccctcaaccagggaaggaataactgtctttaaatgcactgaagaggaggttcccatggagactggggaagttagcataagactatcttccatgatgatgaggaaagactgaatacactgtagcacaggcactcgcagacagacccctggccaggttactgtgggacaggtgcccaagtccatagaagagagaactgtaataaagcaagagggaaatacagtttctttcccaatcaggcagatccacggcaatgctgctttgaggcttcacgtgggcaaggaagacacactgggcagtgatacatggatttctgctagctgctaaagtggtcccatccactcaggtctctgatagtggtcctctggccacaactgtgccaaaataaaataatacatgctatggtaggaaattaatgacctcctaaaatgtctatgtcctaatctcgagaatctgaatatgccgtgtggcatggcagggaaaactggggctgcagaaggcactaaggtggctaaccagctgaccctgagaggagttatcctggattatctggaggatcccactgtaatcataagggtccttaaaatgaaaaggaaggtaggagagttagcaatagagtaatgcaatgcaagaaagattcaactgggcattgcaggggaaaaggggaccatgagccaggaaaggcaggcagccatgggaagtcggaaaaggcgaagaaattgattctctcctagagcttccagaaagcatggccacagtaggagtgaaatggaggcacagagaggggtatttgtctcaagcacacagctattaagtggaggggccactgggatttgaacttagatcaatagaccccagagcctgtgtgcttaactaaggaccctaaaagactattccagcctggtgagctgagttcctgtttgagaggagtctccgcagcctgagtctggggggttttcgcacctgtgggccatgggtgcccccggggaggtggacacgctgcaaggtggaggttgtgtgccacgtttccaggacaccatatggccccaccctggtccaggtgctgctggagcaggacctgtgctgtcactgctctctgacaccgctccactgtctcctccaaaggctcccaccctggtgggctctgcacccacagatttgatgaaactcacaggagtcaagcatcggagagtagtgactgggggttgtgtgtggggagattaaagacatttatatttttctttctcacgtaagatga

SEQ ID NO: 230 - DNA, 76 bp, Homo sapiens
aaacttcaaatttctaaacaaaaatttgattttgctacaattcacacttatgccctccctattcatatctgccaag

SEQ ID NO: 231 - DNA, 180 bp, Homo sapiens
aaatccctctgagtccagaaataagggtatgcatgatattatacctggttttcagggcatttaccaccttttttaaaatagaaaattgagagtacaaaaacactaaacttcaaatttctaaacaaaaatttgattttgctacaattcacacttatgccctccctattcatatctgccaag

SEQ ID NO: 232 - DNA, 7766 bp, Homo sapiens
aaacttcaaatttctaaacaaaaatttgattttgctacaattcacacttatgccctccctattcatatctgccaagaaattttcccaaatttgggaagatttaaatatgcatatttaaaaattattatggcccacctagataagatatagtaacagggaccagagttaccattccaccaaaaacaactaaaagaacaaaaaatatgtgaaaccatgggtttaaagatttatatattaggcaatggacagtgatttctgaaagaaggaaagcaaatgaggtaaattttataattgcctcagcttaccacccaaagcaaatatccaggtatcagttgcagggagcaggagctcagacagagcccagtgatgtccctgagttgaggtgatggagcacaggagtaaggcaaagttaagaaactagagtttacagagcagagtcccagagagagctgcaaagagaatgcacactaaagagatttatagaggggtctcttaaggctttagctgagtactgatcagtgtatttatatgaaggaactactcaaggctggggaaagaaccacctaaaaagattagagaacacagcgctcacaaagagccaggaatcattcctggtccctagagctaaaaatctcataattcatgtgctaccaggtagaatacatagaaggcttcacctcacaagtttgaaaacattagccctagaataaatgctgccctggccctatctaagaaaatttaaaagcaacacatgaaagcatcaaactttttccaaatgatctaactgtatttcacaataaagttcaagaatatttatgggaatacaaaatattcagcatctaaatgtctggcatttaataaaaaattgccagacattcagtaaaagagaaaaatatgacctatgagagaaaagatcaattgacgcctacccagaaattatacatattacataaatagtgggaaaagacatgaaaacagttataattatattctatatgttcaagaagctacaagactgagaagtgtagatagatacagaacattttaaaaacccaagttaatttatagaagaaaactacaaagtttgatataaaaatagactaggttggatgaatggctataatatagccattgaatatagcaggaaaaaacagtaaacttgaagatatagaaataaagctatccaaaaagaaatagaaaaaaaataagctttgagacaacttcaagtggcctaatacatgtgtaatcgaattcctgaaagccaagaaagatagtggagagaaaaacatttttgataagacaatggctaatattttttccatgttagatgaaaactccaaatcctcagatccaagatgatcatcaaacttcaggaataagaaaaatgaataaaatgccatcaaggcaatatgaacatcaaattacttaaaagtaataagagaatatcttaaaagcacccagagaaaaaagaatacaaacattcaatggaacaaggaagaaccatagtgggcagggcacccccggtggctcatgcctataatcccagcactttgggaggctggggcaggcagattacttgaagccaggagtttgagaccagtctggccaacatggaaaaaccctgtctctactaaaaatacaaaaagtagctgggcatcatggtgtgcacctgtaatcccagctactagggagactgaggcacaagaatcatttgaacctgggaggctgagattgtgccactgcactccagcctgggcaacagagtaagactgtctccaaaaaataaaaaataaataaaaaaaaagggggggtggtgaaataccttcaaagtactgaaagaaaaaatgtctaaataaatttaaaagtattctagtcatgttttctggttatgatgtaattaaattagaagttagaaaggtataaggtataggaaatattcccagaatatttggaaactaaataacacacttctaaataacacataatcacaaaagaaatctaaagggaaaacacaatgtatcaaattttgtgggcctggcatggtggttcacacctgtaatcccagcattttgggaggctgaggtgggaggctcacttgaacccaggagtttgagacaagccagagcaacatagtgtgacccccatctctacaaaaaatttaaaaataaaaaattagccaagtgtggtagctcatacgtgtagtcccagctacttgggaggctgaagcaggaggatcgtctgagcccaggaattcaaggctgcagtaagccatgatcacaccactgcactgcagcctgggtgactgaggccctgtctattaaaaaaaaaatgcagctaatgtgacacctaagataaatttatagctctaaatgcctgtttaacaaaaagatctcaaattaatggcatcagcttccaccttaatgaaaacagaacacgaacaaaaacacagtgtaggaagaataaaggaaacaataaagatctagccagtgaaatataaaacaaaaacagaaaaaaaatcaatgaaaccaaaagctggttctttgaaaatatcaataaaacttctagccagattatcaggaaaaaagataatttgccaatatcagaatgaggtgatatcactacatattctacagatattaataaaatatgaactatatcaatacattagattaatgaaatagatgaattatttgaaaggtacaagctcaaccaaaaagaaatatataaattgaatttttctatatctataaaattgaatttgtagttaaaacttcttaaaaagaaaatacaccaggcccagatagctttactggcaaattctttcaaactttaagaagaagtaataccaattttatgcaaacttgtccagataattgaagataaagaggtggaatgcttcctcattatacaaggcaaaatatagagagagaccaacatccctcatgaatatagatgcaaaaattaagttttagcaaatccaacaatacataaacatggtaatatttcatcactaagtaggctttatcccaggaataaggtgatttttagattcaaaagttgataataatgcatcaattaataggcccaaaaaatcaaatcagccacatagtcaatacatggagaaaaagcacttgaaaaatttaatatccatttccaatttaggaaaaaaaaaaccctcacaaataggaataaaaggcaaagtcctaaatctaataaagacgacctacaataaaaaacctacagctaacatcatatttaatggtgaaaggctaaatgctttcttcctaagatcatgaacaagtcaagtatttctgctcttactacctctatttgacatttcactgaaggtttcagccagtaataaacaaaaggcatacagactgaaaaggaagaagtcattattcacagacaacatgattgtctatgtagaaaatctatgaaatctaaataaggtcagcaagcctctagaatacagatcagtatacagaaatcattatattcctatatctagaaatatttagaaattgaaatatttaaaatatcaaaaatatgaaatgcttagggaaaattttgtaagaactatacactgaaaactaaaacacattgctgaacgaaattaaagagctaaataaatggagacatataccatgttcatgaattggaagacttaatatatcaattctcctccagattccccagtagattcaatacaatctcaacaggatttttttggtagaaaggaacaggctacattctaaaatttatacagaaatgaaaaagacatagaatgaaggaattttgaaaaagaacaaagtcggaaaaattaatctacctgatttcaagccttatacagctacagcaatcaagacaatgtgttattggtataaaaatagaaacagattgatgaaacagaaaaattcagaaatagatttatgtataggtggtcacttgatttttgccaaagttgttaagataattcaatgtaaaaaaaggatgttttaaacaaatggtgttagaacagttagatagctatgttaaaaacaataaactttggtctttaccacaccccctatgcaagcatatctcagcgatatgggtttggttccagaccactgcaataaagcaaatagctcagtgaagcaagtcacacagattttttgtttttctactgaaataacagcttatactatactctagactgttaatagcattatacctaaaaataaaaaacccctaaatgtccataccttaatttaaaagtactttgttgccaaaaaatgctaatgattatctgacccttcaatgagtcataatctttttgctgcaaatcatttcctgtctcaatgttggtggttgctgaaggctgggatggctgtggcaatttctgaaaataagacaacaatgaagtttgttgcacttattgactcttcctttcatgagagagccctctgtatagcatgtgatgctggttgatggcattttacccacaagacaacatctctcaaaaattggagtaagtcttctcaaacactgccactgttttatcaactatgtttatggaatattctaaatccttgcttgttatttcaacaatgttcatggcatcttcaccagaagcagattccattgttcaaaaacaaacaaacaaacaaaacacattgttcagttgtaagaagcaactctcattcattccagtttgatcatgagagtgcagcaattcagttacatcatcaaggctccacttctaattcgagctctattgttattttcaccacgttttcagtgattcctccactgaagtcttgaacccctcaaagtcatccatgagggttggaatcaatttcttccaaactcctactaatgtgtatatttcaacctcctcccatgaatcacaaatgttcttgatgatatctaaactggtgaatcatttccagaaggttttcaatttactttgcccagatccatcagaggaattactatctaatagcagctataacctgatgaaatgtatatcttaaataatttgaaagtcagaattactccttgatctggggcctgcagaatggatgctgtgttagcaggcatgaaaacaacattcatttccttgtacatctccaccagagctcttgagtaaccaggtgcattgtcaatgagcagtaatatgttgagaggaatcttttttgggggacagtaggtctcaacagtggccttaaagtattcagtaaactatgctgtaaacagatgtgctgtcatctgggctttgttgttccattgacagagcacagacaaagtagatttagcataattcttaaggaccctagtattttaggaatgctaaattagggttggctttaacttaaagtcaccagctgcattagccctaacaagagccagcctgtcctttgaggctttgaagccaggcatttacttctctagctatggatgtctaagatggcattgtctcccaaaagaaggctgtttcatctacattgaaaagtttgtttagtgtagccactttcattaaggatctcagatcttctggattacttgcttctgcatcaatttgctgcatcactttgcactttgttatggaaatagcttctttccttaaacatcataaatcaacctctgctagcttcaaacttattctgcagtttcctcacctctgtcagcctttacagaattgaagagttaaggccttgttctaggttagattttggtttaaaggactattgttgctgttttaatcttctatccagaccactcaaactttctcccttaatggcaataaggctattttgcttttttattatttgtgttcactgtaggttcacttttaatttccctcaataacttttgccttcacaacttggctaagcatttcatgcaagaggcctagtttttggccaatcttggctatcaacataacatcctcactaagctaaatcacgtctaacttttgatttaaagtgagagatgtgtgactcttcctttcacctgaacacttacatgccattttaaggttattaattggcctaatttcaatattgtgtctcaggcaatagggaggcccaaggagagagagagacatggggaaacagccagtctgtggagcgtcagaacgtacgtcgacgtcgcactgacagattaagtttgtcgtcttatgtgagtatggctccgggtgtcccaaaataattataataataacatcaaagatcactgatcagcataacagatataataatgaaaaagtttaagaattacctaaatgtgacagacatacaaagtgagcacatgctgttggaaaaatggcaccaagagactttgttgccacaaaccttcattttataaaaaaatggaagatccattgggcacgataaagcaaagtgcaataagatgaggtatgcctatacaaaaattaccttaaaaaggcatagagctaaatgcaaaagctaaaactataaaatttgggaaatgaaaaaaacagaaaactttagggaccctaagtttggcaaaaatttaagcatcacaacatacaaatcatgaataaaacatgaaaaaaatagataccaaaatttttaaatttgctctttaaaagacttgcaaaatgaaaagacaagccatggcctgggagaaaatatttacaaaagatatatatctaacaaagcacatcatctatgtatattaaaaatgcttgcaactcagcaatagaatccaaacagcctaatttttaaaaaatgaatatctaacaagacacttcaccagtgaagatggatggcaaattgcatatgaaaagatgctcaacaccgctagtcattagagaaatacaaataaaaccattatgagatactactccactcccactggaatggctaaaattaaagaggctgagcacagcaagtgctgggagaatgctgagcaactggacctctcacacactggtgggaatgtaaaatgttaagaacaatttggaaagtagttcaacctttccttaacaactgaatcatataactcccatatgacccagccattccactcctcagtatttaaccaagaaaactgcaaatctttgtccctacaaaatatttgttcacaaatcctcacagcagctttgtaatagcaaaagttggagttacaatcaacaggtgaacaggtatagtcattcaatggaatactacccctcaataatcaggaatgaagtactgatgcatgtaacaacaccgatacatctcaaaatactgagatgaaagaagccagaccaaaaaaaatatacatactatactattctatttagatgaaattattgaaaatgaaaactatagtaatggaaagcacttcaatggttgcctggggagaggggatgggtgggaagcagagattataatagggcatgaaatatcttctggaggtggtggaaatgttcattgtcttgattgtgctgatggcttcagtggtatttacatgtaatcaattctcataaaattgtatactttgaatatatatatctatctcaaagttttaaaaaatttctataaaatctgctttccatctgtcattgaaaattttgcaaatgatgcttaggtcatccaactgttcatctacaccaagagaatgctgtgtggtcataatctttcctcccttgaaatcctggggctttttcccctctggagtccttccctgtacaagcttccaaagcatgaacttccttcctgaagcatgaaagaaagctctttgctgagtacagcaaacccaccaagttaaataaa

SEQ ID NO: 233 - DNA, 3840 bp, Homo sapiens
ctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtc

SEQ ID NO: 234 - DNA, 8012 bp, Homo sapiens
accttcccataaattcttttaaactatgtgatgattacttcttagttgccaattgcctactgtttgcatccccaatgaaaataagccccacttggttatgttgtcaagaattctctccttccactgttgctttttctcttagctttctccaggtacttcttattaaagagatagcagaaagtttgtgtatgtttgtgtgtgtgaaaattgctttgacaaggacatgtgctcattggctcaatgttcatgtgttcattggctcaatgttcaactttgtggaccaaatcaatttgtttcatgacaatttaaagtaagctacagtaagacaggcagtgcattactatcatggtggatggcatatagtagcttattaaatacttgttgaatgaataaatgattgtattttttaaactggcatcttttttatctttattattatttttcccattgtgctacgtttgctatgaaataaaaatatgggttttagcaattgtaaaaactattctcaaggatttttacattgtaatctagtattaattttcaacttaatttacataatatgttttaaaagtgttatttatgtacaaagaatattaatatacagctataattataataataaaatgaggcatgtatattaattattaatatctcattctagagacgtgaagtattgttcttgtaaaaaacaaaatgttgcaaatcagttgaggtttctcttggccccatatactgaaataatagtgaaggggggcaaatcatacagatgagatacagctaaagcagttcctatacagaaaattataggttaaatttatttattaggaaataagagttgaaaaatcaaaaaatgtaacttctatttcaagaagatagtgaaggaataacaacaaaatctccaaaaaaatgaagaaaataaactggtaaaatcagaaatgaataaaatagaaatatgatataaaataatgtcatcaaagcagaaatttcattccttaacaagttttaaaaaatccataatttaacaaaactgaaagaataaagagataaaacactaaacttattttaatgtataccatttgaactaatgtatgtatacccatttcagggtatacatacccatttcaggtacccagaatatgccatttgaactaatggcacttattccggagtcatgaaaattttacatttcaatctttatggtaaggcattagaatcacccagggagctctcaaaagttgtgatattcaggttcacttgatttatgacagtgacacaattctataaggaatagatggtatttacaatagatagagcaatttaaatgcaagtagaaagaaagaaatcttgagttttatcaaaacattaatttgagttggacaataggcctaagtattcaaggtaaaacaaaaaatcttgtagaaaaactatggtaatattttcatgatttgggataaccatggatacaaccaggaaaaacaaatttcatagacagaattaattaatagaaagcatttccatggaaagacctctgggaataaataatatcatcatatggaatagtactcagccttaaaaaaaggatgaaattctgtcatttgctacaacatggatggaactggagaacattatgttaaataaaataagccaggcacagaaagacaaacactgcatgttctcacttagatgtggaatctaaaacaattgaactcatagaaacaaagtagcatgatgaatactagatgatggggatggggggagtctggagatgatagtcaaaaggtaaaaagttagaaagaataaattcgattattttataacaatagcacagcatgctgaatatagctaatatttgagtcctctgtatttcaatatttctaagagtaaatttctaatgttctcatcaaaaaaaaatattattattatatatatctgacaaatgatatgtaaagaactgcaaatgaataagtaaaattcagtaaaaaataggcaatgcacttgacttgcactgttcaatttgcatttggaaaaatgcaaattaatatcacaatgaggtattatatcatacccattagaatggctaacatcaaaaagaataacaatcccaaattgtggtgaatatgtggagaactagaatgcttacactttgctattagatgtgtaaatcagtgcaagttctttggtgacaaagtttagcattatcttctataggtacataaatacctaccctatgacttaaaatatcatttctaaaaaagttagttcctgtttcaagcaaacacattctaagaatgtctataggaactttatcatattagccaacatttgaaaaagactctaatattcatcaacatgtgaatgggtaaaattgaattaggtattctgatttaattgactatgatgttaacctgaatatcacaacttttgagagctccctgggtgattttaatgccttaccataaagattgaaatgtaaaattttcatgactccagaataagtgccattagttcaaatggcatatttctgggtacctgtctgtctttgatggcttgatttctccatgagtcacaattactgctaggtacaaaggtacttaatcactgatgcagaataatgtatgctttttaaagtgctaccagtgaactctctccaggctgttacataaactgatttcttagattatcatttagtgatcattttttgtaaataatatttttgttattattgtttctcactgaagtgattctgccattattggctgttctagtagataaatactgggttgttaggtttcttaaaaaataatttttatgttgtttgttcctgtctgataccatttctccaaactttctggaaagagaatggccattttaatatatcacagtcacagtgataggggttgtggcacagagattggcatatgaaccaattgcaccagtcacattaagtttttatccttggtatactgattacttctgcttagaatattaaggaagctattaaacatttttcttttaagtggatctgagagtgacagttctctctcctctcttcattgagagagaaaaagtgctctactgcctatttgtctgcccacgatttagcaaactacgtgggttagttttgttcaaaacacgtatagaaacaaaacagagagctgaagcatgtaagttagcggtgataacaacttctttgcagcacttaagtgtcctgtagctcacaaggttcctacaacttttaattcaagtctgtctgctgttatgatattttacctcagaatgtttacgtttctttaagataatattgggtttgctgttgtttgccatgttcttcatttcaggaacatgtgcaaatcattatgttcaccataaatcatcacctcccccataggcattcatgtatctgtattttatttttcattttattttattaagactgcccaaaaccccaaaaatacagattatctttgagactcttgaatgagacatctatgtacaatatcctgaaagaataagatgcttattaaagccaactaattgctcctcatcttgttagtggaaatgaagtctttatattgagctgcctatcctcaccctgagagaataggagcttctgtttctttcaattaataaagcatgtcaactactgctttgttgtactacaaccccaaacccatatctgtatttgtaagactttggaaaaggcagatggatatagttacgcaccttgaacacagaagcagttcttgccctgatctgataataggatttcctatactaggacaggtttgtgaaaacatatgtagttctgaatttaaaaactaaaatgtactcaagataatactatcctggagtatcagagattaggtttgaatcccagcttttgatttcctctctgtgtgagtttcataaaatcaaactctcagagcctcaatctcttcaactaaaataaataagaaaaaaccctttataaaaagctgggtcattgtgaaaaatagcttttttaaaatgcctaaaaatacctggaagcacatcgtgcatgtattagaggtttgaaagcaatacttgtatctattaaaattttccattaattgggaggtactgtcagctgtgggctgattattttttttaagcatttgacattcctggaaggtgtttcttgatttacctgaggatgaagtgtaggagacttgaactggcatggttgatggaaatgacttgattcaacgagtgggtaaaatgaaaaggctaaagtggttttcacaatatgcaagattttgaggtcatagtgggaaggaaagttggactatttttcagccacaaatctaaagcaataaatttctctttgtaccatatcttttttcctgttttaaaaatctttagcatcaatgatacgcctgtatttgaaatagacaatttaagaaaattgtatcctaccatgaataaatattactaaactcttcagagagcaagtttttctacaaacatggtcttatttttaaaatcattcattagcatttatttattgaactctactcttcatcagaaatgttctagacattaggtaggaaaaattaaagaaaatagataggtttcttcaatcgctcataatacactttattcaagaagtagaaagaaatgaaataagcacaaaagttatctataattgcaaatattaagtataataaagaataaagaataaacaagtaataaaagagataaaagagagggtcataatacaagcttgggctaggtaatttatgatgaaattaagccaacatttaaagaaaaaagaaaaggaatgccttacacaaaattggtgtcaagcattttaacaaaagagttctgatgtgaaaactcacaggaagaaaagagctctgtaaattcaaaaacgattcagtaggtcaatgtggctggagattaatgaatatctgatgatgttgaacaagtagaaagggtccagctcatgtagggtctcggaatatgttcttccttcggcttggcgtgttggctcacgcctgtaataccagcactttgggaggccaaggcaggcggatcacttgaggtcaggagtttgagaccaacctggccaacatggtgaaaccctgtctctacaaaaaatacaaaaatcagccaggcgtggtgacatgcgcctgtaatcctagatactcgggaggctgagaggcaagagaatcgcttgaacctgggaggcggaggttgcagtgagcagagattgtgctactgcaccccagcttgggctacagagcaagatttcgtctcaaaaaaaatttctttattgatttaattgtatttctaaagaagtgagagttcaaatttaaaagaggcactcatatattcagtttgcctttttaattactcttgccttgcatagcgaatcttttataaggcagggaacttagcaatattttactgaagaaatgcttggtgacttctagggtggggaaatgatggggcggggattggactgaaaaactatctgttgggtactatgctcactacctgggtccaatacccatgtaaaaatccaacccatatcaaatataaaagctggaatttaaaaaagatggtgacatactaacatgattaaaatggatagagagacagatataatataaaatttgggtctagcagtaaaagaacctggtatagagagactgaatgtagataacgaggaatccaacttctgtcagaactgtaaaaattatcgtttttctgtcttggttgtaatttgttgtttgtatcagaggtgctatcataagacatttatttttattctgcttaactgaaatggggacataaggcaacgtacttcctggttacagttttattcccattctcagtatctagagtgaataaaataagtctgtgataacgataaaaatatgtgttgataattcttggtgtcaaatattaggtttctcaaatttaccttaaatatcttaccagacatttccaggttttctgtcacatatgactgttaaatcttccattgacacaattttgctacaactctcactctaatctgtttagtttttacacaataaacaattggtttcatcagcggaggtacaagtaggagaacatttgccatgagaacattaatgaggggagagacatgcccggcaaagcggtggacaacggccaggttgatgatgggcaggtagaagatgatcactgcacagatgtgtgaaacacaagtattgagagccttaagctcctcctttttggatgcaattcccggtacagtcttgaggatcagggtgtaagacacagcaatgagaataaagtctaccataaggcagagtgctccaaaaaagccatagataacatcaattctgttgtcagaacaggccaacttcatgacatcctggtggagacagtaggaatgggataattggtttttcttgcaatatctcaagcttcttaaagtgaaagggaagggaagaaccaggagcatgctcttaaaggagaatactatccctatttgggcaactctgacagttgtcaggattgaggtgtatctcagaggattgtggatggctaggaatctatcaaatgacatgatcaggaggactgaggactccagtactgagaatccatgaatgaagaattcctgggcaaagcaggcactagaagaagtttcaggggcattgaacaggaagatgcttaacacagtgggcagagatgataaagacaaacccaagtctgacatagccaacatggaaagaaaatagtacatgggcccatgcaaggagggctctgtcttgatgataaaaagaatggtgccatttcctagaatagcaataagatacatgctgcagatggggatagagatccagatgtgtgcatattctagccctggcatcccaaccaagaagaaggtggtgatttcaacatatgatgtgttgataatggacatgattcattcatagggctctgctatgaaaaatacagatacacctgacctcaggtgatccgcttgcttgtgttggtaaaataggcatatctgtaaatttagtagaaaaaaagcagtgttaaaatttgtggcttctttcagctttcttttgagagaacaaagcatttatgtggctatcataatgaagagagatgggtaatactttagagtagaatctgtctattaatgcattgggaaaattatttctggacatgttatttctatagagaatccaggtttaaattttgcagttagttacacgtctgattttatttttcctgtaaaatatgagtaaatcctagtgaattaactggaatgctatactaattctttctttcagatgtatgttgtgatcttcagttctatgtgatcagttgccaaaaaagaagtcaagtgaaagccaaataaatgagaatatctgggcacttaccagagagtggatattttggcgggcatttttgataaaagctaaagaatcctgatatacaaacccaaggcattgctgaatttatctgccacaaaagactgctcttattcacttttacctaaccagtggctctcgggtcacagagttctctggggattgcagccagggtggatcttttctgaaaattggaataaacatttgtagatacagtaaatctacagagatagttgttaccaaggaaactaaaacaacatctagtaacacctgtaataagggatgatttgtttggagagaggtccttaattggcaggtattagagagacatggtaaattctctgcaaaagcttggatatttctgaatggatagttggcttgtgtatttctcctctgcacaaggccaagtctaagcagagatgctatgagttgattctgcattcaaggaagtgttgcaggacaaacatcctgggacacaatgtgttatcctagattttattcctgaatcctggatccatctccccggacccattagacatcgctaactaaatatcccttaaaaccaacttgtccaacttagacaagtttttctcccttaccaaatcttcctagtttaag

SEQ ID NO: 235 - DNA, 19707 bp, Homo sapiens
accttcccataaattcttttaaactatgtgatgattacttcttagttgccaattgcctactgtttgcatccccaatgaaaataagccccacttggttatgttgtcaagaattctctccttccactgttgctttttctcttagctttctccaggtacttcttattaaagagatagcagaaagtttgtgtatgtttgtgtgtgtgaaaattgctttgacaaggacatgtgctcattggctcaatgttcatgtgttcattggctcaatgttcaactttgtggaccaaatcaatttgtttcatgacaatttaaagtaagctacagtaagacaggcagtgcattactatcatggtggatggcatatagtagcttattaaatacttgttgaatgaataaatgattgtattttttaaactggcatcttttttatctttattattatttttcccattgtgctacgtttgctatgaaataaaaatatgggttttagcaattgtaaaaactattctcaaggatttttacattgtaatctagtattaattttcaacttaatttacataatatgttttaaaagtgttatttatgtacaaagaatattaatatacagctataattataataataaaatgaggcatgtatattaattattaatatctcattctagagacgtgaagtattgttcttgtaaaaaacaaaatgttgcaaatcagttgaggtttctcttggccccatatactgaaataatagtgaaggggggcaaatcatacagatgagatacagctaaagcagttcctatacagaaaattataggttaaatttatttattaggaaataagagttgaaaaatcaaaaaatgtaacttctatttcaagaagatagtgaaggaataacaacaaaatctccaaaaaaatgaagaaaataaactggtaaaatcagaaatgaataaaatagaaatatgatataaaataatgtcatcaaagcagaaatttcattccttaacaagttttaaaaaatccataatttaacaaaactgaaagaataaagagataaaacactaaacttattttaatgtataccatttgaactaatgtatgtatacccatttcagggtatacatacccatttcaggtacccagaatatgccatttgaactaatggcacttattccggagtcatgaaaattttacatttcaatctttatggtaaggcattagaatcacccagggagctctcaaaagttgtgatattcaggttcacttgatttatgacagtgacacaattctataaggaatagatggtatttacaatagatagagcaatttaaatgcaagtagaaagaaagaaatcttgagttttatcaaaacattaatttgagttggacaataggcctaagtattcaaggtaaaacaaaaaatcttgtagaaaaactatggtaatattttcatgatttgggataaccatggatacaaccaggaaaaacaaatttcatagacagaattaattaatagaaagcatttccatggaaagacctctgggaataaataatatcatcatatggaatagtactcagccttaaaaaaaggatgaaattctgtcatttgctacaacatggatggaactggagaacattatgttaaataaaataagccaggcacagaaagacaaacactgcatgttctcacttagatgtggaatctaaaacaattgaactcatagaaacaaagtagcatgatgaatactagatgatggggatggggggagtctggagatgatagtcaaaaggtaaaaagttagaaagaataaattcgattattttataacaatagcacagcatgctgaatatagctaatatttgagtcctctgtatttcaatatttctaagagtaaatttctaatgttctcatcaaaaaaaaatattattattatatatatctgacaaatgatatgtaaagaactgcaaatgaataagtaaaattcagtaaaaaataggcaatgcacttgacttgcactgttcaatttgcatttggaaaaatgcaaattaatatcacaatgaggtattatatcatacccattagaatggctaacatcaaaaagaataacaatcccaaattgtggtgaatatgtggagaactagaatgcttacactttgctattagatgtgtaaatcagtgcaagttctttggtgacaaagtttagcattatcttctataggtacataaatacctaccctatgacttaaaatatcatttctaaaaaagttagttcctgtttcaagcaaacacattctaagaatgtctataggaactttatcatattagccaacatttgaaaaagactctaatattcatcaacatgtgaatgggtaaaattgaattaggtattctgatttaattgactatgatgttaacctgaatatcacaacttttgagagctccctgggtgattttaatgccttaccataaagattgaaatgtaaaattttcatgactccagaataagtgccattagttcaaatggcatatttctgggtacctgtctgtctttgatggcttgatttctccatgagtcacaattactgctaggtacaaaggtacttaatcactgatgcagaataatgtatgctttttaaagtgctaccagtgaactctctccaggctgttacataaactgatttcttagattatcatttagtgatcattttttgtaaataatatttttgttattattgtttctcactgaagtgattctgccattattggctgttctagtagataaatactgggttgttaggtttcttaaaaaataatttttatgttgtttgttcctgtctgataccatttctccaaactttctggaaagagaatggccattttaatatatcacagtcacagtgataggggttgtggcacagagattggcatatgaaccaattgcaccagtcacattaagtttttatccttggtatactgattacttctgcttagaatattaaggaagctattaaacatttttcttttaagtggatctgagagtgacagttctctctcctctcttcattgagagagaaaaagtgctctactgcctatttgtctgcccacgatttagcaaactacgtgggttagttttgttcaaaacacgtatagaaacaaaacagagagctgaagcatgtaagttagcggtgataacaacttctttgcagcacttaagtgtcctgtagctcacaaggttcctacaacttttaattcaagtctgtctgctgttatgatattttacctcagaatgtttacgtttctttaagataatattgggtttgctgttgtttgccatgttcttcatttcaggaacatgtgcaaatcattatgttcaccataaatcatcacctcccccataggcattcatgtatctgtattttatttttcattttattttattaagactgcccaaaaccccaaaaatacagattatctttgagactcttgaatgagacatctatgtacaatatcctgaaagaataagatgcttattaaagccaactaattgctcctcatcttgttagtggaaatgaagtctttatattgagctgcctatcctcaccctgagagaataggagcttctgtttctttcaattaataaagcatgtcaactactgctttgttgtactacaaccccaaacccatatctgtatttgtaagactttggaaaaggcagatggatatagttacgcaccttgaacacagaagcagttcttgccctgatctgataataggatttcctatactaggacaggtttgtgaaaacatatgtagttctgaatttaaaaactaaaatgtactcaagataatactatcctggagtatcagagattaggtttgaatcccagcttttgatttcctctctgtgtgagtttcataaaatcaaactctcagagcctcaatctcttcaactaaaataaataagaaaaaaccctttataaaaagctgggtcattgtgaaaaatagcttttttaaaatgcctaaaaatacctggaagcacatcgtgcatgtattagaggtttgaaagcaatacttgtatctattaaaattttccattaattgggaggtactgtcagctgtgggctgattattttttttaagcatttgacattcctggaaggtgtttcttgatttacctgaggatgaagtgtaggagacttgaactggcatggttgatggaaatgacttgattcaacgagtgggtaaaatgaaaaggctaaagtggttttcacaatatgcaagattttgaggtcatagtgggaaggaaagttggactatttttcagccacaaatctaaagcaataaatttctctttgtaccatatcttttttcctgttttaaaaatctttagcatcaatgatacgcctgtatttgaaatagacaatttaagaaaattgtatcctaccatgaataaatattactaaactcttcagagagcaagtttttctacaaacatggtcttatttttaaaatcattcattagcatttatttattgaactctactcttcatcagaaatgttctagacattaggtaggaaaaattaaagaaaatagataggtttcttcaatcgctcataatacactttattcaagaagtagaaagaaatgaaataagcacaaaagttatctataattgcaaatattaagtataataaagaataaagaataaacaagtaataaaagagataaaagagagggtcataatacaagcttgggctaggtaatttatgatgaaattaagccaacatttaaagaaaaaagaaaaggaatgccttacacaaaattggtgtcaagcattttaacaaaagagttctgatgtgaaaactcacaggaagaaaagagctctgtaaattcaaaaacgattcagtaggtcaatgtggctggagattaatgaatatctgatgatgttgaacaagtagaaagggtccagctcatgtagggtctcggaatatgttcttccttcggcttggcgtgttggctcacgcctgtaataccagcactttgggaggccaaggcaggcggatcacttgaggtcaggagtttgagaccaacctggccaacatggtgaaaccctgtctctacaaaaaatacaaaaatcagccaggcgtggtgacatgcgcctgtaatcctagatactcgggaggctgagaggcaagagaatcgcttgaacctgggaggcggaggttgcagtgagcagagattgtgctactgcaccccagcttgggctacagagcaagatttcgtctcaaaaaaaatttctttattgatttaattgtatttctaaagaagtgagagttcaaatttaaaagaggcactcatatattcagtttgcctttttaattactcttgccttgcatagcgaatcttttataaggcagggaacttagcaatattttactgaagaaatgcttggtgacttctagggtggggaaatgatggggcggggattggactgaaaaactatctgttgggtactatgctcactacctgggtccaatacccatgtaaaaatccaacccatatcaaatataaaagctggaatttaaaaaagatggtgacatactaacatgattaaaatggatagagagacagatataatataaaatttgggtctagcagtaaaagaacctggtatagagagactgaatgtagataacgaggaatccaacttctgtcagaactgtaaaaattatcgtttttctgtcttggttgtaatttgttgtttgtatcagaggtgctatcataagacatttatttttattctgcttaactgaaatggggacataaggcaacgtacttcctggttacagttttattcccattctcagtatctagagtgaataaaataagtctgtgataacgataaaaatatgtgttgataattcttggtgtcaaatattaggtttctcaaatttaccttaaatatcttaccagacatttccaggttttctgtcacatatgactgttaaatcttccattgacacaattttgctacaactctcactctaatctgtttagtttttacacaataaacaattggtttcatcagcggaggtacaagtaggagaacatttgccatgagaacattaatgaggggagagacatgcccggcaaagcggtggacaacggccaggttgatgatgggcaggtagaagatgatcactgcacagatgtgtgaaacacaagtattgagagccttaagctcctcctttttggatgcaattcccggtacagtcttgaggatcagggtgtaagacacagcaatgagaataaagtctaccataaggcagagtgctccaaaaaagccatagataacatcaattctgttgtcagaacaggccaacttcatgacatcctggtggagacagtaggaatgggataattggtttttcttgcaatatctcaagcttcttaaagtgaaagggaagggaagaaccaggagcatgctcttaaaggagaatactatccctatttgggcaactctgacagttgtcaggattgaggtgtatctcagaggattgtggatggctaggaatctatcaaatgacatgatcaggaggactgaggactccagtactgagaatccatgaatgaagaattcctgggcaaagcaggcactagaagaagtttcaggggcattgaacaggaagatgcttaacacagtgggcagagatgataaagacaaacccaagtctgacatagccaacatggaaagaaaatagtacatgggcccatgcaaggagggctctgtcttgatgataaaaagaatggtgccatttcctagaatagcaataagatacatgctgcagatggggatagagatccagatgtgtgcatattctagccctggcatcccaaccaagaagaaggtggtgatttcaacatatgatgtgttgataatggacatgattcattcatagggctctgctatgaaaaatacagatacacctgacctcaggtgatccgcttgcttgtgttggtaaaataggcatatctgtaaatttagtagaaaaaaagcagtgttaaaatttgtggcttctttcagctttcttttgagagaacaaagcatttatgtggctatcataatgaagagagatgggtaatactttagagtagaatctgtctattaatgcattgggaaaattatttctggacatgttatttctatagagaatccaggtttaaattttgcagttagttacacgtctgattttatttttcctgtaaaatatgagtaaatcctagtgaattaactggaatgctatactaattctttctttcagatgtatgttgtgatcttcagttctatgtgatcagttgccaaaaaagaagtcaagtgaaagccaaataaatgagaatatctgggcacttaccagagagtggatattttggcgggcatttttgataaaagctaaagaatcctgatatacaaacccaaggcattgctgaatttatctgccacaaaagactgctcttattcacttttacctaaccagtggctctcgggtcacagagttctctggggattgcagccagggtggatcttttctgaaaattggaataaacatttgtagatacagtaaatctacagagatagttgttaccaaggaaactaaaacaacatctagtaacacctgtaataagggatgatttgtttggagagaggtccttaattggcaggtattagagagacatggtaaattctctgcaaaagcttggatatttctgaatggatagttggcttgtgtatttctcctctgcacaaggccaagtctaagcagagatgctatgagttgattctgcattcaaggaagtgttgcaggacaaacatcctgggacacaatgtgttatcctagattttattcctgaatcctggatccatctccccggacccattagacatcgctaactaaatatcccttaaaaccaacttgtccaacttagacaagtttttctcccttaccaaatcttcctagtttaagggacctacttcagtaataagcctttaagaatttgcaagccaaatatctgagattctttgtcttacattttgtacacaataatgaccaatatttcttagaaaattaaattgttttacttactgagttccattaccagatgatgatttggaatcttgaaattttttaaataatataatcaagttatatcattatcttcattttactgatgaagaaaatttttctcaagatcaagtcgtctgtttaagatcacagaagtgttgtagggtagaggtaagatagcaactcaggtctgttattttactgataattaggtgtataccacactgtcaggatggtcaagcaatatttaaagagttatgaactgaatgtagctcgtgagaagtaaaaggcaatttttaaattaagatacacacatttaaatataaacaatgcctgcctgctgtttcatactggcataaaagcaatttttttgaagaaaatgtgtttacatcattgtaaaaacataaacattccaaagagttaaagaatatatttgcaaataaaagtaaagttaatctatatcttctgctttcacaccaatttgtagaaaattggcattattctacaaagggcatccaggtcaattgctcatcataatgccttattcttttttcctctttctttgtcctcttgtaattgggcagcatagcttccaacttgttgtaaaacttttttttattcctttcgtcctttcccccgatgagaaaaactgcagatgtttttctcttatcttgaaatacagcctgaaaatgaggtataaaactccaccttacactcccacaccttatgcacatttgttattctggttgcctgttaaactcacactatgctcatttatcacacacacttctgtttttttttcttttttttttggagatagagtctcactctgtcacccaggttggagtgcagtggatctcgcctcactgcaacctccatctcctaggttcaagcgattctcctgcctcaacctcccaagtagctgggactacaggtgtgagccaacacccaagctaatttttttgtatttttagtagagatggggttttgccatgttggccaggcaggtctcgaactcctgacctcaggtgatccgcttgcttcagcctcccagcatatatttccttagaagcttcagaggcttaattttgacacaactaggcacctccagaattgtcttcccagcagaaaattactccaaggccagaattcactcccaacaagagtttaactgtgagattaactgcaattaatttgtaatctggttgggcccatgatggcgccagctccttcactagatggaacaataattcaagataagacattggagcaagtcacagcagctggcacctcctatccccccttcctcttctgcatttcaatcccctcttcttaaagcccttgtgctctgtccagaatttggaaaagtgacaatttttcgaaataattcctgccgtttttacctcttgctagcgcgaacaataaagctcaccctttttctatcgtatctcactctttttattttttgcttctttctagaagtagtgagtagctgcacccttttgctggttacaatctcatatgatgcaagagtcttatttattttctatagaacaagttcagatttttctattgttgattctttcctaatattcttaaaatctcataatgccttactctgcttctctcttttcatatctatctatctgtctatctatctatcatgtctctatcaaccatctatcttctctatcatctatcatttatatccatctatcatctatctgtatctatctggtttgttaatttgtatttttctttctcctgtatcttttctcttttctctaacttaccatctataacaatatatgcctgctgtgtttctgaggtgctattcctgtagttacgcctcttgagcttttgaattgttttccttgaattaaactacatttcctcaggttgaatcccttgcttagtttgatttctgtctctaagttgcttatcagagggttagtaataaacatacccacaacaaaataaagttttgaaggagatgaacaagaaataataggataactagcagagaatacagaggaatttctagatccaattaacaaatgcagaagataggccgggcgcggtggctcacgcctgtaatcccaccactttgggaggccgaggcgggcagatcatgaggtcatgagatcgagaccatcctggctaacacggtgaaacccagtctctactaaaaatacaaaaaattagccgggcgtggtggcgggcgcctgtagtcccagctactcgggaggctgaggcaggagaacggcgtgaatacgggaggcggagcttgcagtgagctgagatctcgccaccgcactctagcctgggcgacagagagaaactctgtctcaaaaaaaaaaaaaaaaaaaaaaaaaaatcttacaagatttcactgaatttctattacattgcaatttggaaggtacttaccacaaatatcaaaggaggccattatatccacagttgttacaaaatgcctttgtgctgggtataggatgtgtcttcctcaaatatgagtttgaccattctgtcttctcttaataaaagtcagaaaaatcttccaagtcaactctcttgattgaaacacaatccctgccctctcttctgctaggctatacacactttagcctctagaatgtcatcactccccctacttaagtcctctgttgcacgggtctattttcccctgaacacaccagaaagcatcttgcttccataccattgcttcagaagatgatctgaagtaaagtgtgcagggaattcatattatctctttaagtggtatccagttcaatcatttattgtgttgatttattttcttttcttgtcctctattgccctcacgtatgttacaagacccttagaggtttattttgcatataatcagccctaacttgtttattgttgactgttttctaaatatactcatactctcacaatacttttctccattcctctttttcttgaatgtgtttgtgcctgtgtgagtgtgtatgtgtattcatttttctcctatatcttttttctcacctttagactcacaatccataaatcaaaacatatggctgctgtgcttctgagctgttacacctgtgaccacttctctttgagtttttgaaattttttcactgaatttcatttcagccccgcccccccacccaggagaatgccttgctgagacttctgtctccaagttggctattagcaatttagtaataaatatattctcagcaaaataaaattttgaagcaaatggacatggcataatgggttaaatagtgttgaacagaaagaaaattctaggtgcaattggcacataggaagaaaataaatatcttaaaagcaattgattgaatggtgactacattcacgtttttggatagtacttaaccactagtatcaatggagctcaaaaatgcctgtgtgctatgtgcctgattttttttttttctgtaatgttagtttgattattctgtcttaagaaaggtcatgatgccccactccacctcaactgtcaaacatctttattgacatgcaaagacctgctctctgcccagtcaggctagacaaacatccagcctctgtaacatcattcccaccccccacccacttaagttttctgttgctgctacgtgggtctattatctgctaaacacatataccataaaacttcctttttccatactattgcttcagagggtgatctgcaattggatctgatcataatcctgaaagaaataatcctgattgctgaaatctcaaaatatcaaaatctccaaagtccaaaactccaaaaattacagtaccaaaaggccaaaatacagaaaatacatttctgaaaaaaatatttaaaatatatttatttacatttaaaaaggggatttatttgagaaatataaaaagcatagcagaacatttcataagccactttacacaataaaatatataataatgacatacatatttttgcaagcataaatgcaaaggcatatattaacaacaatcacaggggtataatagttactgagcaaacaaacagtatacataaaaagataagtcaaaaagggaaatgtataaatgcatgaagctatagtcagtaattgtatgcactcagctttataactgcaattatctgaaatactgttttgagcaacctaagccttttgatgagatcagtcaaatagtgtgatgagtcatcaccacatatagtcacctaaagagccgagatctcaagaaattttgtcttcacaactgcagatgtacctaaaggatatttcttcatttaccaaggaagtttcagtgtttctacatacacgcatatgtttacacacaaagtcaattttgtgataatgcattttcatggagttaaatttccgatgtccaagggagcagtagaaaagtctgtcctagctttcagtaaaagactaatttggcttctgtatctgttccctctgggcccctggctgattcgatggtgcccagcaacattgagggtagatatttcccacccagtcctcttacacgcacacactgatctcctctggaaataccctcacggacacatccaaaataatattttaccaggtttctagctattccttaatccagtcaagttgacacctaaaattaagtccacaagttcaccccttgtcaatttggcaaccataagcatctccttaaactatacttcatttccaaataaagacaataacaaagtaatagtttcatctaacatgatgcaaccgtcctgcagacaggcaaaaatgtactaatgtactaatctattcttcagaatttggctttcataatttcaacacttgggattttaatttttgggagattgcaatttttgaggttttagatttcagggatatgaacattaagaatttttaacttttgggacttcaactttctgaattatggtattcgggattgtatcttttgagattctgacccaaactcatctgaaatgaagtgtgcagtaatcaatgaaaaacagtttcaaggatacctgtctataaataatactataaatcatttgcctttaatatggaaatacatagaacagaattggcattttcaacattataaaattggagcaacccctgtttttttctgctgcttggagtgctgtgtcttttgttttttgtttttgtttgtttgttttttgtatatttattcctatcctatctgctggtaagcacaaattaatcctcaaatccttggtcaagttctagatcagtagtggaagcagcggcaactcagtgtgtagtgtgctccttgataacattgctgttttgtctcctccctctaaagtctcagaatcacatataagcagatatcattttacttacactaaaatacactgaatgaattaaaagtcctagtctcaatttggagacctctgtatttcaattaagtgattacatgaaatgtatataaaacccactctcacaacattacttagaacttatgaaattatagatttttaggagagtcataaggttgctttcttatttatcaatagaaaaatatatataaagcaaatatttaaacctgattagaagcgtgctgggttaggacagatgatagaggcagaaactcctagtggtcactgttgctttctcacagatgcccattgcaagctcagtggtttcacatatctctacccccaaacaacttatttcaacgtgtaaggcagtaattctataattcaggaaaatgttacctaaaagccagatccaggtacgggattttaatttttttctgtgttgaaatagtaattcgggtttagcacttggttgatttccgaaagttggcacaactctggacttcgatcctgcatttacatacattgttggactttttgacaagttggggtactggcatgcattttaatcacttggagaacagagtcaaacaaaaagcatgtgaacttctgggttgagctggtgcaaaggcaaagtagcaactgtgacattagtaagctaaacagaaagttgataaatagttgagcccacatgtcaaagtacaggggaaatagaaacagaacacacttaccagagttttgctgctgtgtaaatgtaagaatttatcctcatctgccaagtctcatcctgcctaacagatgctttcccattagccaagaaagccctggggattccaactcagcagaatgtacttaaattcctatctaccaataatagacaaacagagagccaaatcatgagtgaactcccattaacaactgctacgaagagaataaaatacttaggaatacaacttacaagggatgtgaaggacctcttcaaggagaactacaaaccactggtcaaggaaataagagaggacacaaacaaatggaaaaacactccatgctcatggataggaagaaccaatatcatgaaaatggccatactgcccaaagtaatttatagattcaatgctatccccatcaagctaccattgactttcttcacagagttagaaaaaactactttaaatttcatatggaaccaaataagagcccatatagccaagacaatcctaagcaaaaagaacaaagccggaggcatcatactacctgacttcaaactatactacaaggctacagtaaccaaaacagcatggtactgtaccaaaacggatatatagaccgatggaacagaacagaggcctcagaaataatgccaaacatctacaaccttctgatctttgtccttgctttttatgacgtgttatttacagaggttcaataagaacctgacttcttttgaagcatgatacaatttgaaagattgatacactgtcttcacaatagttgaactaatttacactcttaccaatggtgtaaaagcgttcctttttctccacaacctcaccagcatctgttggtttttaattttttaattatagcaattctgactggtgtgagatggcatctcatcgtggttttgatttgcatttctctaatgatcagtgaggttgagctttttttcatgtttgttggctgcttgtatgtcttcttttgagaagtatctattcatgtcctttgaccactttttaagggggttgatttttttcttgtaaatttgtttaagttcccatagacgctggatattagatttttgccagatggtcagattgcaaaaaatttctctcattatgtaggttgtctctttactctgttgatagtttcttttgctgtgcagaagctctttagtttaattagatcccatttgtcaatttttggttttgttgcaattgcttttcgtatctttgtcatgaaatctttgcccaagcctatgttcttaatggtattgcctaggttttcttctaaggtttttataattttgagttttacaggtaagtctttaatccatcttgagttgatttttatatatggtgtaagggggacttccagtttcaattttctgcataatggctagccagttttcctagcaccatttattaaataaggaatcctttccccattgcttatttttgtcaggtttgttgaagatcagatggttgtaggtatatggtcttatttctggactgtctattctgttccattggtttatgtgtctgttcttgtaccagtattatggaagacagtgtggtgattcctcaaagacctagaggcaaaaatatcgttcaacccagcaatcccattactcggtatatacctaaaggaatataaattattctattataaatatacgtgcacacatatgttcattgcagtaccattcataatagcaaaaacatggaataaacctaaatgctcacaaatgatagactggataaagaaactgtggtacatacacaccatggaatactatgcagctgtaaaatgaatgagatcatgtccttcgcagcgacaaggatggagctagagaccattatcattagcaaattaccacaggaacagaaaaccaaatactttgtgttctcatttataagtggaggctgaattatgggaacacatggacacatgcaggggaacaacacacactgggacctgttggagagttgggggttgagaggagagaaagaattaggaagaatagctaatggatgttgggcttaatacttaggtgatggaatgatctgtgtagcaaatcaacatggtacacatttacctatgtaacaaacctgtccacatgctgcacatgtaccgctgaactgaaaattaaagttgattatccaacaaaggactttcctggagtatcacattggagaatgtttaatcagatatgaccagccacttttaaggaactatagttgactttatggatccaatgctgacaaatctctcccaagtaagccagcctcttatctggcttatgtggtctagcccttagaagtgctaagaaagatcacatcctagcaagccgagatccttgggatattttgtggactttgagaaaataaaatattacattaaattatagatacctaaaggagcaatttgatgaagagagtttcttgaactaggatttctagattaggtacagatataaaagtggcttttaaatgtctgatttgagattccttatgaaaatttttaagaaggttaaggaggcttagatgataaattaactttttcctttccttacatagataatgaggccaagtttaatgaaagtattgttttgtggtcaatattaatctttctttgagatgattctttttaataaaaactagaaagactacagggaaaagttgtgttttgatggaaaagtatgcattgcttagagcacacccttctgggttatctgattccaaacagatggggaatttgttctttcgttgcctttgagacattttacaactccgtaagttttattggttaacaggaatcaaagtaattcatgtatggagacacgtaactaaattctgtctcatagaggttccatggactttcttctactgtggaagcatccattcctatacttatatgcaaattcacatcaacattcctcctatgactatgtctgttctgtgaattctccttctaagtagttgtagcatttgccacatttcctcacttaaaaaataaattacatgagaacatctttaatggattttttataccgtttaagcaccatgatttgcctttttataaaaattaagtggtttacatttttgtatgggagagagaaaaaatatgtacagtacaatgagttatgcattagtgttaaaaattattcatgacgctttttaagaaaccttaaggaagactttattcatggagactatgacaatagctatgggggtgactactacagtgtgctcttacaatagggaaaagagattagactcaacaaatacagaaggaaaaggaggactttatagccaaaaacagagcagtgatgggcaggaggagttggtgggtagaaaattgctaagaggaaacatcaggggtatgggtgcaggtgtactctggccacactgctctaacagcttgccactgccatcctcactccactatccaccagggtgatcaggcatcatcgggggaatggtagaggataaggtgcctgattcgatatctccagtgattagatatggagggtgaatggctctggttaaactgatttagcaagattcttgctaaattgaacaatacagagataaacacagaaatcctaaagttgaggctagctaagaagagagttcagagatggctgagtagaacttggtcaaggtgagactctctgtcatcaaccctcttgttcaaggaaataagagagattcttctttagtgtgaacaacgttagttcattttcttagtcgtctttttttcatcaaggaaacgctgtcttatctgttacgatgttagtccattttgttcattaaggacaagctatcttatctgttgagactttgtagtcaaggatatttgctggatggtgcaagctgtcaggcctttaatgaagggaattcctgtgaaagcttttttaaaagattgatagttgaaactctcagagggcagctagtagggatttctacctgttgagctcaatgtatctttagatggtggagtgaggatggcagtggcaatatgactaaaggttttgtttgcatttgcaaggcctctagtgatagtgtcaggtgatttggtaaatttctgagtggttcacacaccagcaggcaagaagatatactttgaagtttataacaagttgtccagcttcagcttaaaaggtttggtgaaaggatagttttattctcagtaatgccaagtcagaagggtagaagaaaaattggaaatattaattgggagagttgtagtcagattttagaagaaagtaaaagtggtactcaataagggagtactgtaatttcccagtgaaacaaaattactctttatattcagctctctttacaattcttaatcacaaaaaagtctggtctcattagatttggcttaattatttatgtaagtgcagcaagaatcgcaattaactgcaaaggccttatacgttttctttaccgaaacttttcataagaatctcaaatttgattttaaatattctttcaaggccaagaagccaagccaagaacttaccaccaaagttcatttgcaatacctagagatttgtgtgaatttattctcttcttgaggtccccaagatattctgaggttcctgtacctaccagaaagggaacttctttactgggaacggtgtaagccaggtgtcaggctgtttttttcctagaaggctttattaagctttggcttcataaagtcaaccttgcttccttatatttgattctaagtacatcattctcaaacataatattgtaaccaaaactttgataataaaatcagttttttcaatggtgtcctgttacagattctttttgaacttatctgataactattttacaaagatataagaatagtcaataaaagtttccaaattttgaagggatcaggtagggagaaaagaaaaatgtttcatatttgtttacagcacataatctactaaatttctgtaacttacatattgcttgagagaaaagggaaaggggattcttttattcagaaaataggacattgaaagaatcagcagtgtttcaaaacaaaacccctaattattctttatgagttcattcagtcccatgtaatatattttgttttgcttggttttatgttagcagtttcatgaatccattcagttctaaagatccaataagagttagcttgacaagatatttggttgcttctgtgacacccaacaaaaataatacctggaattactgctgatagcattatattagagcataccgtaaacagaaaaataattcacaaatttctattaactttatatgattgctgaaataataacattttgacaatacaaatataacctaggaaaggttaattatcttttttatttgacaatgtttccatgaaatttagcaagcaaaataaaccaaattattttttaacttttctctacatggtgaaagaacaaatcctttgagagttttcagaggccctctgggaaatctcaagatcaattcaagaacaagaagatttcatttaggatttgattttggaaaggcaacattttcaaaaata

SEQ ID NO: 236 - DNA, 25380 bp, Homo sapiens
accttcccataaattcttttaaactatgtgatgattacttcttagttgccaattgcctactgtttgcatccccaatgaaaataagccccacttggttatgttgtcaagaattctctccttccactgttgctttttctcttagctttctccaggtacttcttattaaagagatagcagaaagtttgtgtatgtttgtgtgtgtgaaaattgctttgacaaggacatgtgctcattggctcaatgttcatgtgttcattggctcaatgttcaactttgtggaccaaatcaatttgtttcatgacaatttaaagtaagctacagtaagacaggcagtgcattactatcatggtggatggcatatagtagcttattaaatacttgttgaatgaataaatgattgtattttttaaactggcatcttttttatctttattattatttttcccattgtgctacgtttgctatgaaataaaaatatgggttttagcaattgtaaaaactattctcaaggatttttacattgtaatctagtattaattttcaacttaatttacataatatgttttaaaagtgttatttatgtacaaagaatattaatatacagctataattataataataaaatgaggcatgtatattaattattaatatctcattctagagacgtgaagtattgttcttgtaaaaaacaaaatgttgcaaatcagttgaggtttctcttggccccatatactgaaataatagtgaaggggggcaaatcatacagatgagatacagctaaagcagttcctatacagaaaattataggttaaatttatttattaggaaataagagttgaaaaatcaaaaaatgtaacttctatttcaagaagatagtgaaggaataacaacaaaatctccaaaaaaatgaagaaaataaactggtaaaatcagaaatgaataaaatagaaatatgatataaaataatgtcatcaaagcagaaatttcattccttaacaagttttaaaaaatccataatttaacaaaactgaaagaataaagagataaaacactaaacttattttaatgtataccatttgaactaatgtatgtatacccatttcagggtatacatacccatttcaggtacccagaatatgccatttgaactaatggcacttattccggagtcatgaaaattttacatttcaatctttatggtaaggcattagaatcacccagggagctctcaaaagttgtgatattcaggttcacttgatttatgacagtgacacaattctataaggaatagatggtatttacaatagatagagcaatttaaatgcaagtagaaagaaagaaatcttgagttttatcaaaacattaatttgagttggacaataggcctaagtattcaaggtaaaacaaaaaatcttgtagaaaaactatggtaatattttcatgatttgggataaccatggatacaaccaggaaaaacaaatttcatagacagaattaattaatagaaagcatttccatggaaagacctctgggaataaataatatcatcatatggaatagtactcagccttaaaaaaaggatgaaattctgtcatttgctacaacatggatggaactggagaacattatgttaaataaaataagccaggcacagaaagacaaacactgcatgttctcacttagatgtggaatctaaaacaattgaactcatagaaacaaagtagcatgatgaatactagatgatggggatggggggagtctggagatgatagtcaaaaggtaaaaagttagaaagaataaattcgattattttataacaatagcacagcatgctgaatatagctaatatttgagtcctctgtatttcaatatttctaagagtaaatttctaatgttctcatcaaaaaaaaatattattattatatatatctgacaaatgatatgtaaagaactgcaaatgaataagtaaaattcagtaaaaaataggcaatgcacttgacttgcactgttcaatttgcatttggaaaaatgcaaattaatatcacaatgaggtattatatcatacccattagaatggctaacatcaaaaagaataacaatcccaaattgtggtgaatatgtggagaactagaatgcttacactttgctattagatgtgtaaatcagtgcaagttctttggtgacaaagtttagcattatcttctataggtacataaatacctaccctatgacttaaaatatcatttctaaaaaagttagttcctgtttcaagcaaacacattctaagaatgtctataggaactttatcatattagccaacatttgaaaaagactctaatattcatcaacatgtgaatgggtaaaattgaattaggtattctgatttaattgactatgatgttaacctgaatatcacaacttttgagagctccctgggtgattttaatgccttaccataaagattgaaatgtaaaattttcatgactccagaataagtgccattagttcaaatggcatatttctgggtacctgtctgtctttgatggcttgatttctccatgagtcacaattactgctaggtacaaaggtacttaatcactgatgcagaataatgtatgctttttaaagtgctaccagtgaactctctccaggctgttacataaactgatttcttagattatcatttagtgatcattttttgtaaataatatttttgttattattgtttctcactgaagtgattctgccattattggctgttctagtagataaatactgggttgttaggtttcttaaaaaataatttttatgttgtttgttcctgtctgataccatttctccaaactttctggaaagagaatggccattttaatatatcacagtcacagtgataggggttgtggcacagagattggcatatgaaccaattgcaccagtcacattaagtttttatccttggtatactgattacttctgcttagaatattaaggaagctattaaacatttttcttttaagtggatctgagagtgacagttctctctcctctcttcattgagagagaaaaagtgctctactgcctatttgtctgcccacgatttagcaaactacgtgggttagttttgttcaaaacacgtatagaaacaaaacagagagctgaagcatgtaagttagcggtgataacaacttctttgcagcacttaagtgtcctgtagctcacaaggttcctacaacttttaattcaagtctgtctgctgttatgatattttacctcagaatgtttacgtttctttaagataatattgggtttgctgttgtttgccatgttcttcatttcaggaacatgtgcaaatcattatgttcaccataaatcatcacctcccccataggcattcatgtatctgtattttatttttcattttattttattaagactgcccaaaaccccaaaaatacagattatctttgagactcttgaatgagacatctatgtacaatatcctgaaagaataagatgcttattaaagccaactaattgctcctcatcttgttagtggaaatgaagtctttatattgagctgcctatcctcaccctgagagaataggagcttctgtttctttcaattaataaagcatgtcaactactgctttgttgtactacaaccccaaacccatatctgtatttgtaagactttggaaaaggcagatggatatagttacgcaccttgaacacagaagcagttcttgccctgatctgataataggatttcctatactaggacaggtttgtgaaaacatatgtagttctgaatttaaaaactaaaatgtactcaagataatactatcctggagtatcagagattaggtttgaatcccagcttttgatttcctctctgtgtgagtttcataaaatcaaactctcagagcctcaatctcttcaactaaaataaataagaaaaaaccctttataaaaagctgggtcattgtgaaaaatagcttttttaaaatgcctaaaaatacctggaagcacatcgtgcatgtattagaggtttgaaagcaatacttgtatctattaaaattttccattaattgggaggtactgtcagctgtgggctgattattttttttaagcatttgacattcctggaaggtgtttcttgatttacctgaggatgaagtgtaggagacttgaactggcatggttgatggaaatgacttgattcaacgagtgggtaaaatgaaaaggctaaagtggttttcacaatatgcaagattttgaggtcatagtgggaaggaaagttggactatttttcagccacaaatctaaagcaataaatttctctttgtaccatatcttttttcctgttttaaaaatctttagcatcaatgatacgcctgtatttgaaatagacaatttaagaaaattgtatcctaccatgaataaatattactaaactcttcagagagcaagtttttctacaaacatggtcttatttttaaaatcattcattagcatttatttattgaactctactcttcatcagaaatgttctagacattaggtaggaaaaattaaagaaaatagataggtttcttcaatcgctcataatacactttattcaagaagtagaaagaaatgaaataagcacaaaagttatctataattgcaaatattaagtataataaagaataaagaataaacaagtaataaaagagataaaagagagggtcataatacaagcttgggctaggtaatttatgatgaaattaagccaacatttaaagaaaaaagaaaaggaatgccttacacaaaattggtgtcaagcattttaacaaaagagttctgatgtgaaaactcacaggaagaaaagagctctgtaaattcaaaaacgattcagtaggtcaatgtggctggagattaatgaatatctgatgatgttgaacaagtagaaagggtccagctcatgtagggtctcggaatatgttcttccttcggcttggcgtgttggctcacgcctgtaataccagcactttgggaggccaaggcaggcggatcacttgaggtcaggagtttgagaccaacctggccaacatggtgaaaccctgtctctacaaaaaatacaaaaatcagccaggcgtggtgacatgcgcctgtaatcctagatactcgggaggctgagaggcaagagaatcgcttgaacctgggaggcggaggttgcagtgagcagagattgtgctactgcaccccagcttgggctacagagcaagatttcgtctcaaaaaaaatttctttattgatttaattgtatttctaaagaagtgagagttcaaatttaaaagaggcactcatatattcagtttgcctttttaattactcttgccttgcatagcgaatcttttataaggcagggaacttagcaatattttactgaagaaatgcttggtgacttctagggtggggaaatgatggggcggggattggactgaaaaactatctgttgggtactatgctcactacctgggtccaatacccatgtaaaaatccaacccatatcaaatataaaagctggaatttaaaaaagatggtgacatactaacatgattaaaatggatagagagacagatataatataaaatttgggtctagcagtaaaagaacctggtatagagagactgaatgtagataacgaggaatccaacttctgtcagaactgtaaaaattatcgtttttctgtcttggttgtaatttgttgtttgtatcagaggtgctatcataagacatttatttttattctgcttaactgaaatggggacataaggcaacgtacttcctggttacagttttattcccattctcagtatctagagtgaataaaataagtctgtgataacgataaaaatatgtgttgataattcttggtgtcaaatattaggtttctcaaatttaccttaaatatcttaccagacatttccaggttttctgtcacatatgactgttaaatcttccattgacacaattttgctacaactctcactctaatctgtttagtttttacacaataaacaattggtttcatcagcggaggtacaagtaggagaacatttgccatgagaacattaatgaggggagagacatgcccggcaaagcggtggacaacggccaggttgatgatgggcaggtagaagatgatcactgcacagatgtgtgaaacacaagtattgagagccttaagctcctcctttttggatgcaattcccggtacagtcttgaggatcagggtgtaagacacagcaatgagaataaagtctaccataaggcagagtgctccaaaaaagccatagataacatcaattctgttgtcagaacaggccaacttcatgacatcctggtggagacagtaggaatgggataattggtttttcttgcaatatctcaagcttcttaaagtgaaagggaagggaagaaccaggagcatgctcttaaaggagaatactatccctatttgggcaactctgacagttgtcaggattgaggtgtatctcagaggattgtggatggctaggaatctatcaaatgacatgatcaggaggactgaggactccagtactgagaatccatgaatgaagaattcctgggcaaagcaggcactagaagaagtttcaggggcattgaacaggaagatgcttaacacagtgggcagagatgataaagacaaacccaagtctgacatagccaacatggaaagaaaatagtacatgggcccatgcaaggagggctctgtcttgatgataaaaagaatggtgccatttcctagaatagcaataagatacatgctgcagatggggatagagatccagatgtgtgcatattctagccctggcatcccaaccaagaagaaggtggtgatttcaacatatgatgtgttgataatggacatgattcattcatagggctctgctatgaaaaatacagatacacctgacctcaggtgatccgcttgcttgtgttggtaaaataggcatatctgtaaatttagtagaaaaaaagcagtgttaaaatttgtggcttctttcagctttcttttgagagaacaaagcatttatgtggctatcataatgaagagagatgggtaatactttagagtagaatctgtctattaatgcattgggaaaattatttctggacatgttatttctatagagaatccaggtttaaattttgcagttagttacacgtctgattttatttttcctgtaaaatatgagtaaatcctagtgaattaactggaatgctatactaattctttctttcagatgtatgttgtgatcttcagttctatgtgatcagttgccaaaaaagaagtcaagtgaaagccaaataaatgagaatatctgggcacttaccagagagtggatattttggcgggcatttttgataaaagctaaagaatcctgatatacaaacccaaggcattgctgaatttatctgccacaaaagactgctcttattcacttttacctaaccagtggctctcgggtcacagagttctctggggattgcagccagggtggatcttttctgaaaattggaataaacatttgtagatacagtaaatctacagagatagttgttaccaaggaaactaaaacaacatctagtaacacctgtaataagggatgatttgtttggagagaggtccttaattggcaggtattagagagacatggtaaattctctgcaaaagcttggatatttctgaatggatagttggcttgtgtatttctcctctgcacaaggccaagtctaagcagagatgctatgagttgattctgcattcaaggaagtgttgcaggacaaacatcctgggacacaatgtgttatcctagattttattcctgaatcctggatccatctccccggacccattagacatcgctaactaaatatcccttaaaaccaacttgtccaacttagacaagtttttctcccttaccaaatcttcctagtttaagggacctacttcagtaataagcctttaagaatttgcaagccaaatatctgagattctttgtcttacattttgtacacaataatgaccaatatttcttagaaaattaaattgttttacttactgagttccattaccagatgatgatttggaatcttgaaattttttaaataatataatcaagttatatcattatcttcattttactgatgaagaaaatttttctcaagatcaagtcgtctgtttaagatcacagaagtgttgtagggtagaggtaagatagcaactcaggtctgttattttactgataattaggtgtataccacactgtcaggatggtcaagcaatatttaaagagttatgaactgaatgtagctcgtgagaagtaaaaggcaatttttaaattaagatacacacatttaaatataaacaatgcctgcctgctgtttcatactggcataaaagcaatttttttgaagaaaatgtgtttacatcattgtaaaaacataaacattccaaagagttaaagaatatatttgcaaataaaagtaaagttaatctatatcttctgctttcacaccaatttgtagaaaattggcattattctacaaagggcatccaggtcaattgctcatcataatgccttattcttttttcctctttctttgtcctcttgtaattgggcagcatagcttccaacttgttgtaaaacttttttttattcctttcgtcctttcccccgatgagaaaaactgcagatgtttttctcttatcttgaaatacagcctgaaaatgaggtataaaactccaccttacactcccacaccttatgcacatttgttattctggttgcctgttaaactcacactatgctcatttatcacacacacttctgtttttttttcttttttttttggagatagagtctcactctgtcacccaggttggagtgcagtggatctcgcctcactgcaacctccatctcctaggttcaagcgattctcctgcctcaacctcccaagtagctgggactacaggtgtgagccaacacccaagctaatttttttgtatttttagtagagatggggttttgccatgttggccaggcaggtctcgaactcctgacctcaggtgatccgcttgcttcagcctcccagcatatatttccttagaagcttcagaggcttaattttgacacaactaggcacctccagaattgtcttcccagcagaaaattactccaaggccagaattcactcccaacaagagtttaactgtgagattaactgcaattaatttgtaatctggttgggcccatgatggcgccagctccttcactagatggaacaataattcaagataagacattggagcaagtcacagcagctggcacctcctatccccccttcctcttctgcatttcaatcccctcttcttaaagcccttgtgctctgtccagaatttggaaaagtgacaatttttcgaaataattcctgccgtttttacctcttgctagcgcgaacaataaagctcaccctttttctatcgtatctcactctttttattttttgcttctttctagaagtagtgagtagctgcacccttttgctggttacaatctcatatgatgcaagagtcttatttattttctatagaacaagttcagatttttctattgttgattctttcctaatattcttaaaatctcataatgccttactctgcttctctcttttcatatctatctatctgtctatctatctatcatgtctctatcaaccatctatcttctctatcatctatcatttatatccatctatcatctatctgtatctatctggtttgttaatttgtatttttctttctcctgtatcttttctcttttctctaacttaccatctataacaatatatgcctgctgtgtttctgaggtgctattcctgtagttacgcctcttgagcttttgaattgttttccttgaattaaactacatttcctcaggttgaatcccttgcttagtttgatttctgtctctaagttgcttatcagagggttagtaataaacatacccacaacaaaataaagttttgaaggagatgaacaagaaataataggataactagcagagaatacagaggaatttctagatccaattaacaaatgcagaagataggccgggcgcggtggctcacgcctgtaatcccaccactttgggaggccgaggcgggcagatcatgaggtcatgagatcgagaccatcctggctaacacggtgaaacccagtctctactaaaaatacaaaaaattagccgggcgtggtggcgggcgcctgtagtcccagctactcgggaggctgaggcaggagaacggcgtgaatacgggaggcggagcttgcagtgagctgagatctcgccaccgcactctagcctgggcgacagagagaaactctgtctcaaaaaaaaaaaaaaaaaaaaaaaaaaatcttacaagatttcactgaatttctattacattgcaatttggaaggtacttaccacaaatatcaaaggaggccattatatccacagttgttacaaaatgcctttgtgctgggtataggatgtgtcttcctcaaatatgagtttgaccattctgtcttctcttaataaaagtcagaaaaatcttccaagtcaactctcttgattgaaacacaatccctgccctctcttctgctaggctatacacactttagcctctagaatgtcatcactccccctacttaagtcctctgttgcacgggtctattttcccctgaacacaccagaaagcatcttgcttccataccattgcttcagaagatgatctgaagtaaagtgtgcagggaattcatattatctctttaagtggtatccagttcaatcatttattgtgttgatttattttcttttcttgtcctctattgccctcacgtatgttacaagacccttagaggtttattttgcatataatcagccctaacttgtttattgttgactgttttctaaatatactcatactctcacaatacttttctccattcctctttttcttgaatgtgtttgtgcctgtgtgagtgtgtatgtgtattcatttttctcctatatcttttttctcacctttagactcacaatccataaatcaaaacatatggctgctgtgcttctgagctgttacacctgtgaccacttctctttgagtttttgaaattttttcactgaatttcatttcagccccgcccccccacccaggagaatgccttgctgagacttctgtctccaagttggctattagcaatttagtaataaatatattctcagcaaaataaaattttgaagcaaatggacatggcataatgggttaaatagtgttgaacagaaagaaaattctaggtgcaattggcacataggaagaaaataaatatcttaaaagcaattgattgaatggtgactacattcacgtttttggatagtacttaaccactagtatcaatggagctcaaaaatgcctgtgtgctatgtgcctgattttttttttttctgtaatgttagtttgattattctgtcttaagaaaggtcatgatgccccactccacctcaactgtcaaacatctttattgacatgcaaagacctgctctctgcccagtcaggctagacaaacatccagcctctgtaacatcattcccaccccccacccacttaagttttctgttgctgctacgtgggtctattatctgctaaacacatataccataaaacttcctttttccatactattgcttcagagggtgatctgcaattggatctgatcataatcctgaaagaaataatcctgattgctgaaatctcaaaatatcaaaatctccaaagtccaaaactccaaaaattacagtaccaaaaggccaaaatacagaaaatacatttctgaaaaaaatatttaaaatatatttatttacatttaaaaaggggatttatttgagaaatataaaaagcatagcagaacatttcataagccactttacacaataaaatatataataatgacatacatatttttgcaagcataaatgcaaaggcatatattaacaacaatcacaggggtataatagttactgagcaaacaaacagtatacataaaaagataagtcaaaaagggaaatgtataaatgcatgaagctatagtcagtaattgtatgcactcagctttataactgcaattatctgaaatactgttttgagcaacctaagccttttgatgagatcagtcaaatagtgtgatgagtcatcaccacatatagtcacctaaagagccgagatctcaagaaattttgtcttcacaactgcagatgtacctaaaggatatttcttcatttaccaaggaagtttcagtgtttctacatacacgcatatgtttacacacaaagtcaattttgtgataatgcattttcatggagttaaatttccgatgtccaagggagcagtagaaaagtctgtcctagctttcagtaaaagactaatttggcttctgtatctgttccctctgggcccctggctgattcgatggtgcccagcaacattgagggtagatatttcccacccagtcctcttacacgcacacactgatctcctctggaaataccctcacggacacatccaaaataatattttaccaggtttctagctattccttaatccagtcaagttgacacctaaaattaagtccacaagttcaccccttgtcaatttggcaaccataagcatctccttaaactatacttcatttccaaataaagacaataacaaagtaatagtttcatctaacatgatgcaaccgtcctgcagacaggcaaaaatgtactaatgtactaatctattcttcagaatttggctttcataatttcaacacttgggattttaatttttgggagattgcaatttttgaggttttagatttcagggatatgaacattaagaatttttaacttttgggacttcaactttctgaattatggtattcgggattgtatcttttgagattctgacccaaactcatctgaaatgaagtgtgcagtaatcaatgaaaaacagtttcaaggatacctgtctataaataatactataaatcatttgcctttaatatggaaatacatagaacagaattggcattttcaacattataaaattggagcaacccctgtttttttctgctgcttggagtgctgtgtcttttgttttttgtttttgtttgtttgttttttgtatatttattcctatcctatctgctggtaagcacaaattaatcctcaaatccttggtcaagttctagatcagtagtggaagcagcggcaactcagtgtgtagtgtgctccttgataacattgctgttttgtctcctccctctaaagtctcagaatcacatataagcagatatcattttacttacactaaaatacactgaatgaattaaaagtcctagtctcaatttggagacctctgtatttcaattaagtgattacatgaaatgtatataaaacccactctcacaacattacttagaacttatgaaattatagatttttaggagagtcataaggttgctttcttatttatcaatagaaaaatatatataaagcaaatatttaaacctgattagaagcgtgctgggttaggacagatgatagaggcagaaactcctagtggtcactgttgctttctcacagatgcccattgcaagctcagtggtttcacatatctctacccccaaacaacttatttcaacgtgtaaggcagtaattctataattcaggaaaatgttacctaaaagccagatccaggtacgggattttaatttttttctgtgttgaaatagtaattcgggtttagcacttggttgatttccgaaagttggcacaactctggacttcgatcctgcatttacatacattgttggactttttgacaagttggggtactggcatgcattttaatcacttggagaacagagtcaaacaaaaagcatgtgaacttctgggttgagctggtgcaaaggcaaagtagcaactgtgacattagtaagctaaacagaaagttgataaatagttgagcccacatgtcaaagtacaggggaaatagaaacagaacacacttaccagagttttgctgctgtgtaaatgtaagaatttatcctcatctgccaagtctcatcctgcctaacagatgctttcccattagccaagaaagccctggggattccaactcagcagaatgtacttaaattcctatctaccaataatagacaaacagagagccaaatcatgagtgaactcccattaacaactgctacgaagagaataaaatacttaggaatacaacttacaagggatgtgaaggacctcttcaaggagaactacaaaccactggtcaaggaaataagagaggacacaaacaaatggaaaaacactccatgctcatggataggaagaaccaatatcatgaaaatggccatactgcccaaagtaatttatagattcaatgctatccccatcaagctaccattgactttcttcacagagttagaaaaaactactttaaatttcatatggaaccaaataagagcccatatagccaagacaatcctaagcaaaaagaacaaagccggaggcatcatactacctgacttcaaactatactacaaggctacagtaaccaaaacagcatggtactgtaccaaaacggatatatagaccgatggaacagaacagaggcctcagaaataatgccaaacatctacaaccttctgatctttgtccttgctttttatgacgtgttatttacagaggttcaataagaacctgacttcttttgaagcatgatacaatttgaaagattgatacactgtcttcacaatagttgaactaatttacactcttaccaatggtgtaaaagcgttcctttttctccacaacctcaccagcatctgttggtttttaattttttaattatagcaattctgactggtgtgagatggcatctcatcgtggttttgatttgcatttctctaatgatcagtgaggttgagctttttttcatgtttgttggctgcttgtatgtcttcttttgagaagtatctattcatgtcctttgaccactttttaagggggttgatttttttcttgtaaatttgtttaagttcccatagacgctggatattagatttttgccagatggtcagattgcaaaaaatttctctcattatgtaggttgtctctttactctgttgatagtttcttttgctgtgcagaagctctttagtttaattagatcccatttgtcaatttttggttttgttgcaattgcttttcgtatctttgtcatgaaatctttgcccaagcctatgttcttaatggtattgcctaggttttcttctaaggtttttataattttgagttttacaggtaagtctttaatccatcttgagttgatttttatatatggtgtaagggggacttccagtttcaattttctgcataatggctagccagttttcctagcaccatttattaaataaggaatcctttccccattgcttatttttgtcaggtttgttgaagatcagatggttgtaggtatatggtcttatttctggactgtctattctgttccattggtttatgtgtctgttcttgtaccagtattatggaagacagtgtggtgattcctcaaagacctagaggcaaaaatatcgttcaacccagcaatcccattactcggtatatacctaaaggaatataaattattctattataaatatacgtgcacacatatgttcattgcagtaccattcataatagcaaaaacatggaataaacctaaatgctcacaaatgatagactggataaagaaactgtggtacatacacaccatggaatactatgcagctgtaaaatgaatgagatcatgtccttcgcagcgacaaggatggagctagagaccattatcattagcaaattaccacaggaacagaaaaccaaatactttgtgttctcatttataagtggaggctgaattatgggaacacatggacacatgcaggggaacaacacacactgggacctgttggagagttgggggttgagaggagagaaagaattaggaagaatagctaatggatgttgggcttaatacttaggtgatggaatgatctgtgtagcaaatcaacatggtacacatttacctatgtaacaaacctgtccacatgctgcacatgtaccgctgaactgaaaattaaagttgattatccaacaaaggactttcctggagtatcacattggagaatgtttaatcagatatgaccagccacttttaaggaactatagttgactttatggatccaatgctgacaaatctctcccaagtaagccagcctcttatctggcttatgtggtctagcccttagaagtgctaagaaagatcacatcctagcaagccgagatccttgggatattttgtggactttgagaaaataaaatattacattaaattatagatacctaaaggagcaatttgatgaagagagtttcttgaactaggatttctagattaggtacagatataaaagtggcttttaaatgtctgatttgagattccttatgaaaatttttaagaaggttaaggaggcttagatgataaattaactttttcctttccttacatagataatgaggccaagtttaatgaaagtattgttttgtggtcaatattaatctttctttgagatgattctttttaataaaaactagaaagactacagggaaaagttgtgttttgatggaaaagtatgcattgcttagagcacacccttctgggttatctgattccaaacagatggggaatttgttctttcgttgcctttgagacattttacaactccgtaagttttattggttaacaggaatcaaagtaattcatgtatggagacacgtaactaaattctgtctcatagaggttccatggactttcttctactgtggaagcatccattcctatacttatatgcaaattcacatcaacattcctcctatgactatgtctgttctgtgaattctccttctaagtagttgtagcatttgccacatttcctcacttaaaaaataaattacatgagaacatctttaatggattttttataccgtttaagcaccatgatttgcctttttataaaaattaagtggtttacatttttgtatgggagagagaaaaaatatgtacagtacaatgagttatgcattagtgttaaaaattattcatgacgctttttaagaaaccttaaggaagactttattcatggagactatgacaatagctatgggggtgactactacagtgtgctcttacaatagggaaaagagattagactcaacaaatacagaaggaaaaggaggactttatagccaaaaacagagcagtgatgggcaggaggagttggtgggtagaaaattgctaagaggaaacatcaggggtatgggtgcaggtgtactctggccacactgctctaacagcttgccactgccatcctcactccactatccaccagggtgatcaggcatcatcgggggaatggtagaggataaggtgcctgattcgatatctccagtgattagatatggagggtgaatggctctggttaaactgatttagcaagattcttgctaaattgaacaatacagagataaacacagaaatcctaaagttgaggctagctaagaagagagttcagagatggctgagtagaacttggtcaaggtgagactctctgtcatcaaccctcttgttcaaggaaataagagagattcttctttagtgtgaacaacgttagttcattttcttagtcgtctttttttcatcaaggaaacgctgtcttatctgttacgatgttagtccattttgttcattaaggacaagctatcttatctgttgagactttgtagtcaaggatatttgctggatggtgcaagctgtcaggcctttaatgaagggaattcctgtgaaagcttttttaaaagattgatagttgaaactctcagagggcagctagtagggatttctacctgttgagctcaatgtatctttagatggtggagtgaggatggcagtggcaatatgactaaaggttttgtttgcatttgcaaggcctctagtgatagtgtcaggtgatttggtaaatttctgagtggttcacacaccagcaggcaagaagatatactttgaagtttataacaagttgtccagcttcagcttaaaaggtttggtgaaaggatagttttattctcagtaatgccaagtcagaagggtagaagaaaaattggaaatattaattgggagagttgtagtcagattttagaagaaagtaaaagtggtactcaataagggagtactgtaatttcccagtgaaacaaaattactctttatattcagctctctttacaattcttaatcacaaaaaagtctggtctcattagatttggcttaattatttatgtaagtgcagcaagaatcgcaattaactgcaaaggccttatacgttttctttaccgaaacttttcataagaatctcaaatttgattttaaatattctttcaaggccaagaagccaagccaagaacttaccaccaaagttcatttgcaatacctagagatttgtgtgaatttattctcttcttgaggtccccaagatattctgaggttcctgtacctaccagaaagggaacttctttactgggaacggtgtaagccaggtgtcaggctgtttttttcctagaaggctttattaagctttggcttcataaagtcaaccttgcttccttatatttgattctaagtacatcattctcaaacataatattgtaaccaaaactttgataataaaatcagttttttcaatggtgtcctgttacagattctttttgaacttatctgataactattttacaaagatataagaatagtcaataaaagtttccaaattttgaagggatcaggtagggagaaaagaaaaatgtttcatatttgtttacagcacataatctactaaatttctgtaacttacatattgcttgagagaaaagggaaaggggattcttttattcagaaaataggacattgaaagaatcagcagtgtttcaaaacaaaacccctaattattctttatgagttcattcagtcccatgtaatatattttgttttgcttggttttatgttagcagtttcatgaatccattcagttctaaagatccaataagagttagcttgacaagatatttggttgcttctgtgacacccaacaaaaataatacctggaattactgctgatagcattatattagagcataccgtaaacagaaaaataattcacaaatttctattaactttatatgattgctgaaataataacattttgacaatacaaatataacctaggaaaggttaattatcttttttatttgacaatgtttccatgaaatttagcaagcaaaataaaccaaattattttttaacttttctctacatggtgaaagaacaaatcctttgagagttttcagaggccctctgggaaatctcaagatcaattcaagaacaagaagatttcatttaggatttgattttggaaaggcaacattttcaaaaataaaaaaaaagagttattttaaaagtgtgaagacttgattctcttaaataattattttcttaaaataatctcttaaatagtctttatcatagcataaatagcataaaatgtagcaaactattctgataagacacagaactttggttttctagtagattactaaaaaggtatagaaaaacacttttacaatttcttattaagagcagacaaataatccatgaaagtttgtcatttttgtcttgcatctgtataattttgacattaaagataattaataaaaataaataaatccacttacatatttagtcaacttgaccacacataaaattcctctttacaagcaatctatacctttgaaaaatatccatgtgagttttcatttcctcattcaggaatacccagtcatactttagaatgaaattactttagaatacaattacctttttctttcctaaacaacatcatatctttcatacttcatactttttcttcttgaaaacacactggactttccttaaatgttttttaaacagagttgttttccttattatttaagtagttttgtccacatacattgattataacttttaaccatcagtttctttctttacagagaaaactataacagaaaatagacaaatgtgaattgtcataagcccagattcggtaacaggattgcaaatttattaatacataatttcacaatttctagaggcatatacttactcatagaacaatttttcaatgtgacaaaaacgtttattaatgaactcaagtataagtaactcatataaaacatataacaataagatgccaaaagagtgtaaacttaaacttatgcttagtaatgaatattgtactagtttatcttattagaaatgacctagatacttaacaaatatctattattaatgaaacttagcctaacattaaggttgcaagttactaaaatattctggaaattatttcaaggtaaacataacaccaaacaaagctagccattatctcatatctcaagtaatttacctgttaaccctttttatatgacaggcatgttaggtaaacattacaaaagtagaaacctaaaaagttagatacatttttgtttatttttgtttgtttgttttactgctgtgcttgacatacataaagtatttatattaaacaattaattttaactgcatctttactcatgcacatgttcctaggttgaataattttcataattttaaacatccagtagatatactattaccttactcaacttttaaacccaagtaaagtaaaatatgctttttattatgtttaatgctgataactcagaagatacaagggtttttattaagcaaacgttattaaactaggctcacttgccaaagatacgcctatgtcaagtaaatttgaaaataattttgtttagttttttcctaggaattttaggaatatttcatttacaggcactcactaatctgcatgccaatttgaataaagctcctttaaggtattttataaactaatttggtaatactattcagaagtagaaaaatattgcatctacataacatgtttacatgaatgcataaacacacagacgagccacagagatcttatacgtttcattttaaaattcttagctatgagttagtaaagcatagtaatacaaaaaactcactggtttatataaagtagttcttatctttaatacaatttatatttctgtccaaacagtatttttgacaaaaatggaataaattgaggttactgactcaataaggtctaaatctttttttaaaccagtatttatggggaattcttatgattttcttttgttctgatatataatctgacagaagctgtgggctaccttttaggcaagtgcctgaggaaacatcaagcagcaatctggctgtttccaaagctcctctgagtggataaaatatccagtctattttcagttaaccctttccccctctttctgcctcagatgattgctgtttggggttcctgagcaccttgaaagctcttgatgtgtacagggagttcaagtgagtatagagaggtgagccacttaagctgaggtttattgtggaggctgtggtgaggctattctggggatggaggtgccaggtgggccagtcatcagtctccttaggggcaagtgctagtgcacagcagttccttcttggtattaagtaaggttgtttttagtggtgctggtgagaccaaatggtctgtccttgaacccttgggagtgcatttctggtggtggctatggcagtggcagacccaggaaagattgtcctcaggtcatcaggcattgtgcaccggtgccagtggtggtgatatcagcaaaggccctagatgggctgattctcaggccccgcaggggcttatggtgctggtgccaccctgctttcaaaatggtgccatgatgcaacagcatgcggcctggggtgaagggagtgaatagacctggtggagcacacagtcggcaaatattcaagaagggaatttcaattgactgagaaattcccattaggaaaagaagaatcaaatggaagtaataaaacgttctcacaaaccatcatgaaaaaaattccagctcacaaatcaggaaataaattttaatcaaaataaggatccaggaagaacacataccccaaaagttgaggaataatccccactcaagacagagccaggaagaaagacttccagcccagcagttacctgtcaaagagagaagcctgaacttgggcctctaactcagtttctgcttacctgggattgtagcacagcttcttgagtacacacaaaaccttaagaatcaaatctgtccttactatcattcaacaggctgtcaaaagtgtgtacacagggtcctaagtgaaaagtctgggggtccagtgatacatgtgatcctgagtcatggcacctcaaacattaaagaaaaaattacttatgatgcttaaagaacagtaagaaaaactttattaacagagagtaacgtgatatgtataggagcttgttgtagggagagggattgggctcaactctaaatgaacagtgaaaagtaagaatgtatggaaaaggagtaaggttggggacataggttactaagtagaaaattattaaaaggaaacatcaagagtagggaagattttggcttagtctgttttgtgttgctgtaaaggaaaatgtctcagtctaggtactttatagcaaaatgggtttatttggctcacagttctgcagactgtacaagaaacatgacaccaatatctggttctggcgagatcctcagaaagcctctactcattggtggaaggggaaagggagaaggtatcacaggcaagaggaaggaagcaagataaaacgaaagaggaagaagtagccaggctctttttttaacagccagatctcacaggaacatagagtgagaactcactcaatcctgcaagaatggtaccacgcccttcatgagggattcacccacatgacacaaacaactccacactaggccccatctccaacattggggattaaattttaatatgagatcaggaggggacaaatgtccaaagcatgtaattgacctaacaggattcttgctatcagcaagccagaattatcacatatcaagtgggaatggtagaatatgaggaaatcaattaaacatctagagtaaccagatatggaggggaaggggctttggttaaactgacctagcatgactcttgctaaaatcgaacaatatggagataaatatgaaaatcaaggccaagttgagaacacagttcagaggaacctgggtagaggagatagtctttgtcattaggtagaattcccattgaaatgtcaaagacaggaatctgtcaccttagaaaatgacatttcatgttaaggaaggagatattgaattaaataaaatgagtaaataaagcattgtttattttatttttatatttttcatgtatgcatgttagtttttttgaatagtttcatgttcaagagtgttattgcccatcttaatttcaattcctgagaacaagcacatatctcaaagatgtcaaaaatatgtgctgaaaataagtactttaaataaagaggtagtctttggtcacctctgatcactgcccagttatcatgtaagtgtataccattaattttcaaattaacatagacaatattattttaatcattatgaaaatgacaagaatacattgtgttcataggagtggtaagggaaactgcataagagtgaaacctgggaatacattttatttacataagagtcccaagcctgaatactgaaccaacagatttgcaagtttgattctttaatcctaatgaacagattgagaaattatattgtaaagtgattaacatagtatgttttcttattgatctattctgcttgttttcttgactttgggttaagcatcatgtggttaagcatccgcttcagctttgcttctggcacagtttttctaagacaagatttcttatctgctggctcttcacacagtatacaatggggttcatcaatggaggcaccagcagaaaagcatcagctatgaggatcctagtgattgggaaactgtgtttggcaaaccggtagatgacagctagggagataatgggcacatagaagatgagcacagcacagatgtgggaaacacatgtattgaggaccttgagccttttctttcatgatgctatgctcaacactgctttcagtatcaacatgtaggacatgaaaataaatgtcaagtctaggatgcctgtgagagccacaaataagccatagatgatgttgaccttgttgtcagtgcaggccagtttcatgacatcttgatggaggcagtaggattgggacaggaggttcttcttacaatattttagatgttttagagtgaaaggaaatgggaggatcaacaaaacatttttgagagaaaaagcaagcccaatttgaatgactctggcactggtgaggatggaagtgtatctcagggggttgcagatggcaataaagcgatcaaaggacattataagaagtacagatgactccatagctgagaatccatggatgaaaaactcttgagcaatacaggcatcaggggaaattcctggagcattgaacaggaaaatccttaacatggtagggagagaggagagggatagtcccaggtcagagagagccaacatggagagaaaatagtacatgggctcatgcaaagaaggctctgtttttatgaaaaacagaatggtacaattccctaggatagcaacagtgtacatgagacatatggggatagagatccaaatattggcatgctccaaacctgggatcccaaccaagtagaaaatagagatttccatttcagaggtattgagaatggacatcccagtatttgagggaaaagatgagaagctcataagaggttttctgtagaggtataagtagatcggctcaaatgcctggctctatcctattgaactcattgaggtcttacaacaccaggtatatagacataattcttagacacaaacctaaaaggagaaatagataggtagactcaactagaaacaaaaaaccgagaaaaaataatgcaaattgatatcaaaatctaatcttaaaatagatacagattataacaggtacaagtcctatacaa

SEQ ID NO: 237 - DNA, 23700 bp, Homo sapiens
accttcccataaattcttttaaactatgtgatgattacttcttagttgccaattgcctactgtttgcatccccaatgaaaataagccccacttggttatgttgtcaagaattctctccttccactgttgctttttctcttagctttctccaggtacttcttattaaagagatagcagaaagtttgtgtatgtttgtgtgtgtgaaaattgctttgacaaggacatgtgctcattggctcaatgttcatgtgttcattggctcaatgttcaactttgtggaccaaatcaatttgtttcatgacaatttaaagtaagctacagtaagacaggcagtgcattactatcatggtggatggcatatagtagcttattaaatacttgttgaatgaataaatgattgtattttttaaactggcatcttttttatctttattattatttttcccattgtgctacgtttgctatgaaataaaaatatgggttttagcaattgtaaaaactattctcaaggatttttacattgtaatctagtattaattttcaacttaatttacataatatgttttaaaagtgttatttatgtacaaagaatattaatatacagctataattataataataaaatgaggcatgtatattaattattaatatctcattctagagacgtgaagtattgttcttgtaaaaaacaaaatgttgcaaatcagttgaggtttctcttggccccatatactgaaataatagtgaaggggggcaaatcatacagatgagatacagctaaagcagttcctatacagaaaattataggttaaatttatttattaggaaataagagttgaaaaatcaaaaaatgtaacttctatttcaagaagatagtgaaggaataacaacaaaatctccaaaaaaatgaagaaaataaactggtaaaatcagaaatgaataaaatagaaatatgatataaaataatgtcatcaaagcagaaatttcattccttaacaagttttaaaaaatccataatttaacaaaactgaaagaataaagagataaaacactaaacttattttaatgtataccatttgaactaatgtatgtatacccatttcagggtatacatacccatttcaggtacccagaatatgccatttgaactaatggcacttattccggagtcatgaaaattttacatttcaatctttatggtaaggcattagaatcacccagggagctctcaaaagttgtgatattcaggttcacttgatttatgacagtgacacaattctataaggaatagatggtatttacaatagatagagcaatttaaatgcaagtagaaagaaagaaatcttgagttttatcaaaacattaatttgagttggacaataggcctaagtattcaaggtaaaacaaaaaatcttgtagaaaaactatggtaatattttcatgatttgggataaccatggatacaaccaggaaaaacaaatttcatagacagaattaattaatagaaagcatttccatggaaagacctctgggaataaataatatcatcatatggaatagtactcagccttaaaaaaaggatgaaattctgtcatttgctacaacatggatggaactggagaacattatgttaaataaaataagccaggcacagaaagacaaacactgcatgttctcacttagatgtggaatctaaaacaattgaactcatagaaacaaagtagcatgatgaatactagatgatggggatggggggagtctggagatgatagtcaaaaggtaaaaagttagaaagaataaattcgattattttataacaatagcacagcatgctgaatatagctaatatttgagtcctctgtatttcaatatttctaagagtaaatttctaatgttctcatcaaaaaaaaatattattattatatatatctgacaaatgatatgtaaagaactgcaaatgaataagtaaaattcagtaaaaaataggcaatgcacttgacttgcactgttcaatttgcatttggaaaaatgcaaattaatatcacaatgaggtattatatcatacccattagaatggctaacatcaaaaagaataacaatcccaaattgtggtgaatatgtggagaactagaatgcttacactttgctattagatgtgtaaatcagtgcaagttctttggtgacaaagtttagcattatcttctataggtacataaatacctaccctatgacttaaaatatcatttctaaaaaagttagttcctgtttcaagcaaacacattctaagaatgtctataggaactttatcatattagccaacatttgaaaaagactctaatattcatcaacatgtgaatgggtaaaattgaattaggtattctgatttaattgactatgatgttaacctgaatatcacaacttttgagagctccctgggtgattttaatgccttaccataaagattgaaatgtaaaattttcatgactccagaataagtgccattagttcaaatggcatatttctgggtacctgtctgtctttgatggcttgatttctccatgagtcacaattactgctaggtacaaaggtacttaatcactgatgcagaataatgtatgctttttaaagtgctaccagtgaactctctccaggctgttacataaactgatttcttagattatcatttagtgatcattttttgtaaataatatttttgttattattgtttctcactgaagtgattctgccattattggctgttctagtagataaatactgggttgttaggtttcttaaaaaataatttttatgttgtttgttcctgtctgataccatttctccaaactttctggaaagagaatggccattttaatatatcacagtcacagtgataggggttgtggcacagagattggcatatgaaccaattgcaccagtcacattaagtttttatccttggtatactgattacttctgcttagaatattaaggaagctattaaacatttttcttttaagtggatctgagagtgacagttctctctcctctcttcattgagagagaaaaagtgctctactgcctatttgtctgcccacgatttagcaaactacgtgggttagttttgttcaaaacacgtatagaaacaaaacagagagctgaagcatgtaagttagcggtgataacaacttctttgcagcacttaagtgtcctgtagctcacaaggttcctacaacttttaattcaagtctgtctgctgttatgatattttacctcagaatgtttacgtttctttaagataatattgggtttgctgttgtttgccatgttcttcatttcaggaacatgtgcaaatcattatgttcaccataaatcatcacctcccccataggcattcatgtatctgtattttatttttcattttattttattaagactgcccaaaaccccaaaaatacagattatctttgagactcttgaatgagacatctatgtacaatatcctgaaagaataagatgcttattaaagccaactaattgctcctcatcttgttagtggaaatgaagtctttatattgagctgcctatcctcaccctgagagaataggagcttctgtttctttcaattaataaagcatgtcaactactgctttgttgtactacaaccccaaacccatatctgtatttgtaagactttggaaaaggcagatggatatagttacgcaccttgaacacagaagcagttcttgccctgatctgataataggatttcctatactaggacaggtttgtgaaaacatatgtagttctgaatttaaaaactaaaatgtactcaagataatactatcctggagtatcagagattaggtttgaatcccagcttttgatttcctctctgtgtgagtttcataaaatcaaactctcagagcctcaatctcttcaactaaaataaataagaaaaaaccctttataaaaagctgggtcattgtgaaaaatagcttttttaaaatgcctaaaaatacctggaagcacatcgtgcatgtattagaggtttgaaagcaatacttgtatctattaaaattttccattaattgggaggtactgtcagctgtgggctgattattttttttaagcatttgacattcctggaaggtgtttcttgatttacctgaggatgaagtgtaggagacttgaactggcatggttgatggaaatgacttgattcaacgagtgggtaaaatgaaaaggctaaagtggttttcacaatatgcaagattttgaggtcatagtgggaaggaaagttggactatttttcagccacaaatctaaagcaataaatttctctttgtaccatatcttttttcctgttttaaaaatctttagcatcaatgatacgcctgtatttgaaatagacaatttaagaaaattgtatcctaccatgaataaatattactaaactcttcagagagcaagtttttctacaaacatggtcttatttttaaaatcattcattagcatttatttattgaactctactcttcatcagaaatgttctagacattaggtaggaaaaattaaagaaaatagataggtttcttcaatcgctcataatacactttattcaagaagtagaaagaaatgaaataagcacaaaagttatctataattgcaaatattaagtataataaagaataaagaataaacaagtaataaaagagataaaagagagggtcataatacaagcttgggctaggtaatttatgatgaaattaagccaacatttaaagaaaaaagaaaaggaatgccttacacaaaattggtgtcaagcattttaacaaaagagttctgatgtgaaaactcacaggaagaaaagagctctgtaaattcaaaaacgattcagtaggtcaatgtggctggagattaatgaatatctgatgatgttgaacaagtagaaagggtccagctcatgtagggtctcggaatatgttcttccttcggcttggcgtgttggctcacgcctgtaataccagcactttgggaggccaaggcaggcggatcacttgaggtcaggagtttgagaccaacctggccaacatggtgaaaccctgtctctacaaaaaatacaaaaatcagccaggcgtggtgacatgcgcctgtaatcctagatactcgggaggctgagaggcaagagaatcgcttgaacctgggaggcggaggttgcagtgagcagagattgtgctactgcaccccagcttgggctacagagcaagatttcgtctcaaaaaaaatttctttattgatttaattgtatttctaaagaagtgagagttcaaatttaaaagaggcactcatatattcagtttgcctttttaattactcttgccttgcatagcgaatcttttataaggcagggaacttagcaatattttactgaagaaatgcttggtgacttctagggtggggaaatgatggggcggggattggactgaaaaactatctgttgggtactatgctcactacctgggtccaatacccatgtaaaaatccaacccatatcaaatataaaagctggaatttaaaaaagatggtgacatactaacatgattaaaatggatagagagacagatataatataaaatttgggtctagcagtaaaagaacctggtatagagagactgaatgtagataacgaggaatccaacttctgtcagaactgtaaaaattatcgtttttctgtcttggttgtaatttgttgtttgtatcagaggtgctatcataagacatttatttttattctgcttaactgaaatggggacataaggcaacgtacttcctggttacagttttattcccattctcagtatctagagtgaataaaataagtctgtgataacgataaaaatatgtgttgataattcttggtgtcaaatattaggtttctcaaatttaccttaaatatcttaccagacatttccaggttttctgtcacatatgactgttaaatcttccattgacacaattttgctacaactctcactctaatctgtttagtttttacacaataaacaattggtttcatcagcggaggtacaagtaggagaacatttgccatgagaacattaatgaggggagagacatgcccggcaaagcggtggacaacggccaggttgatgatgggcaggtagaagatgatcactgcacagatgtgtgaaacacaagtattgagagccttaagctcctcctttttggatgcaattcccggtacagtcttgaggatcagggtgtaagacacagcaatgagaataaagtctaccataaggcagagtgctccaaaaaagccatagataacatcaattctgttgtcagaacaggccaacttcatgacatcctggtggagacagtaggaatgggataattggtttttcttgcaatatctcaagcttcttaaagtgaaagggaagggaagaaccaggagcatgctcttaaaggagaatactatccctatttgggcaactctgacagttgtcaggattgaggtgtatctcagaggattgtggatggctaggaatctatcaaatgacatgatcaggaggactgaggactccagtactgagaatccatgaatgaagaattcctgggcaaagcaggcactagaagaagtttcaggggcattgaacaggaagatgcttaacacagtgggcagagatgataaagacaaacccaagtctgacatagccaacatggaaagaaaatagtacatgggcccatgcaaggagggctctgtcttgatgataaaaagaatggtgccatttcctagaatagcaataagatacatgctgcagatggggatagagatccagatgtgtgcatattctagccctggcatcccaaccaagaagaaggtggtgatttcaacatatgatgtgttgataatggacatgattcattcatagggctctgctatgaaaaatacagatacacctgacctcaggtgatccgcttgcttgtgttggtaaaataggcatatctgtaaatttagtagaaaaaaagcagtgttaaaatttgtggcttctttcagctttcttttgagagaacaaagcatttatgtggctatcataatgaagagagatgggtaatactttagagtagaatctgtctattaatgcattgggaaaattatttctggacatgttatttctatagagaatccaggtttaaattttgcagttagttacacgtctgattttatttttcctgtaaaatatgagtaaatcctagtgaattaactggaatgctatactaattctttctttcagatgtatgttgtgatcttcagttctatgtgatcagttgccaaaaaagaagtcaagtgaaagccaaataaatgagaatatctgggcacttaccagagagtggatattttggcgggcatttttgataaaagctaaagaatcctgatatacaaacccaaggcattgctgaatttatctgccacaaaagactgctcttattcacttttacctaaccagtggctctcgggtcacagagttctctggggattgcagccagggtggatcttttctgaaaattggaataaacatttgtagatacagtaaatctacagagatagttgttaccaaggaaactaaaacaacatctagtaacacctgtaataagggatgatttgtttggagagaggtccttaattggcaggtattagagagacatggtaaattctctgcaaaagcttggatatttctgaatggatagttggcttgtgtatttctcctctgcacaaggccaagtctaagcagagatgctatgagttgattctgcattcaaggaagtgttgcaggacaaacatcctgggacacaatgtgttatcctagattttattcctgaatcctggatccatctccccggacccattagacatcgctaactaaatatcccttaaaaccaacttgtccaacttagacaagtttttctcccttaccaaatcttcctagtttaagggacctacttcagtaataagcctttaagaatttgcaagccaaatatctgagattctttgtcttacattttgtacacaataatgaccaatatttcttagaaaattaaattgttttacttactgagttccattaccagatgatgatttggaatcttgaaattttttaaataatataatcaagttatatcattatcttcattttactgatgaagaaaatttttctcaagatcaagtcgtctgtttaagatcacagaagtgttgtagggtagaggtaagatagcaactcaggtctgttattttactgataattaggtgtataccacactgtcaggatggtcaagcaatatttaaagagttatgaactgaatgtagctcgtgagaagtaaaaggcaatttttaaattaagatacacacatttaaatataaacaatgcctgcctgctgtttcatactggcataaaagcaatttttttgaagaaaatgtgtttacatcattgtaaaaacataaacattccaaagagttaaagaatatatttgcaaataaaagtaaagttaatctatatcttctgctttcacaccaatttgtagaaaattggcattattctacaaagggcatccaggtcaattgctcatcataatgccttattcttttttcctctttctttgtcctcttgtaattgggcagcatagcttccaacttgttgtaaaacttttttttattcctttcgtcctttcccccgatgagaaaaactgcagatgtttttctcttatcttgaaatacagcctgaaaatgaggtataaaactccaccttacactcccacaccttatgcacatttgttattctggttgcctgttaaactcacactatgctcatttatcacacacacttctgtttttttttcttttttttttggagatagagtctcactctgtcacccaggttggagtgcagtggatctcgcctcactgcaacctccatctcctaggttcaagcgattctcctgcctcaacctcccaagtagctgggactacaggtgtgagccaacacccaagctaatttttttgtatttttagtagagatggggttttgccatgttggccaggcaggtctcgaactcctgacctcaggtgatccgcttgcttcagcctcccagcatatatttccttagaagcttcagaggcttaattttgacacaactaggcacctccagaattgtcttcccagcagaaaattactccaaggccagaattcactcccaacaagagtttaactgtgagattaactgcaattaatttgtaatctggttgggcccatgatggcgccagctccttcactagatggaacaataattcaagataagacattggagcaagtcacagcagctggcacctcctatccccccttcctcttctgcatttcaatcccctcttcttaaagcccttgtgctctgtccagaatttggaaaagtgacaatttttcgaaataattcctgccgtttttacctcttgctagcgcgaacaataaagctcaccctttttctatcgtatctcactctttttattttttgcttctttctagaagtagtgagtagctgcacccttttgctggttacaatctcatatgatgcaagagtcttatttattttctatagaacaagttcagatttttctattgttgattctttcctaatattcttaaaatctcataatgccttactctgcttctctcttttcatatctatctatctgtctatctatctatcatgtctctatcaaccatctatcttctctatcatctatcatttatatccatctatcatctatctgtatctatctggtttgttaatttgtatttttctttctcctgtatcttttctcttttctctaacttaccatctataacaatatatgcctgctgtgtttctgaggtgctattcctgtagttacgcctcttgagcttttgaattgttttccttgaattaaactacatttcctcaggttgaatcccttgcttagtttgatttctgtctctaagttgcttatcagagggttagtaataaacatacccacaacaaaataaagttttgaaggagatgaacaagaaataataggataactagcagagaatacagaggaatttctagatccaattaacaaatgcagaagataggccgggcgcggtggctcacgcctgtaatcccaccactttgggaggccgaggcgggcagatcatgaggtcatgagatcgagaccatcctggctaacacggtgaaacccagtctctactaaaaatacaaaaaattagccgggcgtggtggcgggcgcctgtagtcccagctactcgggaggctgaggcaggagaacggcgtgaatacgggaggcggagcttgcagtgagctgagatctcgccaccgcactctagcctgggcgacagagagaaactctgtctcaaaaaaaaaaaaaaaaaaaaaaaaaaatcttacaagatttcactgaatttctattacattgcaatttggaaggtacttaccacaaatatcaaaggaggccattatatccacagttgttacaaaatgcctttgtgctgggtataggatgtgtcttcctcaaatatgagtttgaccattctgtcttctcttaataaaagtcagaaaaatcttccaagtcaactctcttgattgaaacacaatccctgccctctcttctgctaggctatacacactttagcctctagaatgtcatcactccccctacttaagtcctctgttgcacgggtctattttcccctgaacacaccagaaagcatcttgcttccataccattgcttcagaagatgatctgaagtaaagtgtgcagggaattcatattatctctttaagtggtatccagttcaatcatttattgtgttgatttattttcttttcttgtcctctattgccctcacgtatgttacaagacccttagaggtttattttgcatataatcagccctaacttgtttattgttgactgttttctaaatatactcatactctcacaatacttttctccattcctctttttcttgaatgtgtttgtgcctgtgtgagtgtgtatgtgtattcatttttctcctatatcttttttctcacctttagactcacaatccataaatcaaaacatatggctgctgtgcttctgagctgttacacctgtgaccacttctctttgagtttttgaaattttttcactgaatttcatttcagccccgcccccccacccaggagaatgccttgctgagacttctgtctccaagttggctattagcaatttagtaataaatatattctcagcaaaataaaattttgaagcaaatggacatggcataatgggttaaatagtgttgaacagaaagaaaattctaggtgcaattggcacataggaagaaaataaatatcttaaaagcaattgattgaatggtgactacattcacgtttttggatagtacttaaccactagtatcaatggagctcaaaaatgcctgtgtgctatgtgcctgattttttttttttctgtaatgttagtttgattattctgtcttaagaaaggtcatgatgccccactccacctcaactgtcaaacatctttattgacatgcaaagacctgctctctgcccagtcaggctagacaaacatccagcctctgtaacatcattcccaccccccacccacttaagttttctgttgctgctacgtgggtctattatctgctaaacacatataccataaaacttcctttttccatactattgcttcagagggtgatctgcaattggatctgatcataatcctgaaagaaataatcctgattgctgaaatctcaaaatatcaaaatctccaaagtccaaaactccaaaaattacagtaccaaaaggccaaaatacagaaaatacatttctgaaaaaaatatttaaaatatatttatttacatttaaaaaggggatttatttgagaaatataaaaagcatagcagaacatttcataagccactttacacaataaaatatataataatgacatacatatttttgcaagcataaatgcaaaggcatatattaacaacaatcacaggggtataatagttactgagcaaacaaacagtatacataaaaagataagtcaaaaagggaaatgtataaatgcatgaagctatagtcagtaattgtatgcactcagctttataactgcaattatctgaaatactgttttgagcaacctaagccttttgatgagatcagtcaaatagtgtgatgagtcatcaccacatatagtcacctaaagagccgagatctcaagaaattttgtcttcacaactgcagatgtacctaaaggatatttcttcatttaccaaggaagtttcagtgtttctacatacacgcatatgtttacacacaaagtcaattttgtgataatgcattttcatggagttaaatttccgatgtccaagggagcagtagaaaagtctgtcctagctttcagtaaaagactaatttggcttctgtatctgttccctctgggcccctggctgattcgatggtgcccagcaacattgagggtagatatttcccacccagtcctcttacacgcacacactgatctcctctggaaataccctcacggacacatccaaaataatattttaccaggtttctagctattccttaatccagtcaagttgacacctaaaattaagtccacaagttcaccccttgtcaatttggcaaccataagcatctccttaaactatacttcatttccaaataaagacaataacaaagtaatagtttcatctaacatgatgcaaccgtcctgcagacaggcaaaaatgtactaatgtactaatctattcttcagaatttggctttcataatttcaacacttgggattttaatttttgggagattgcaatttttgaggttttagatttcagggatatgaacattaagaatttttaacttttgggacttcaactttctgaattatggtattcgggattgtatcttttgagattctgacccaaactcatctgaaatgaagtgtgcagtaatcaatgaaaaacagtttcaaggatacctgtctataaataatactataaatcatttgcctttaatatggaaatacatagaacagaattggcattttcaacattataaaattggagcaacccctgtttttttctgctgcttggagtgctgtgtcttttgttttttgtttttgtttgtttgttttttgtatatttattcctatcctatctgctggtaagcacaaattaatcctcaaatccttggtcaagttctagatcagtagtggaagcagcggcaactcagtgtgtagtgtgctccttgataacattgctgttttgtctcctccctctaaagtctcagaatcacatataagcagatatcattttacttacactaaaatacactgaatgaattaaaagtcctagtctcaatttggagacctctgtatttcaattaagtgattacatgaaatgtatataaaacccactctcacaacattacttagaacttatgaaattatagatttttaggagagtcataaggttgctttcttatttatcaatagaaaaatatatataaagcaaatatttaaacctgattagaagcgtgctgggttaggacagatgatagaggcagaaactcctagtggtcactgttgctttctcacagatgcccattgcaagctcagtggtttcacatatctctacccccaaacaacttatttcaacgtgtaaggcagtaattctataattcaggaaaatgttacctaaaagccagatccaggtacgggattttaatttttttctgtgttgaaatagtaattcgggtttagcacttggttgatttccgaaagttggcacaactctggacttcgatcctgcatttacatacattgttggactttttgacaagttggggtactggcatgcattttaatcacttggagaacagagtcaaacaaaaagcatgtgaacttctgggttgagctggtgcaaaggcaaagtagcaactgtgacattagtaagctaaacagaaagttgataaatagttgagcccacatgtcaaagtacaggggaaatagaaacagaacacacttaccagagttttgctgctgtgtaaatgtaagaatttatcctcatctgccaagtctcatcctgcctaacagatgctttcccattagccaagaaagccctggggattccaactcagcagaatgtacttaaattcctatctaccaataatagacaaacagagagccaaatcatgagtgaactcccattaacaactgctacgaagagaataaaatacttaggaatacaacttacaagggatgtgaaggacctcttcaaggagaactacaaaccactggtcaaggaaataagagaggacacaaacaaatggaaaaacactccatgctcatggataggaagaaccaatatcatgaaaatggccatactgcccaaagtaatttatagattcaatgctatccccatcaagctaccattgactttcttcacagagttagaaaaaactactttaaatttcatatggaaccaaataagagcccatatagccaagacaatcctaagcaaaaagaacaaagccggaggcatcatactacctgacttcaaactatactacaaggctacagtaaccaaaacagcatggtactgtaccaaaacggatatatagaccgatggaacagaacagaggcctcagaaataatgccaaacatctacaaccttctgatctttgtccttgctttttatgacgtgttatttacagaggttcaataagaacctgacttcttttgaagcatgatacaatttgaaagattgatacactgtcttcacaatagttgaactaatttacactcttaccaatggtgtaaaagcgttcctttttctccacaacctcaccagcatctgttggtttttaattttttaattatagcaattctgactggtgtgagatggcatctcatcgtggttttgatttgcatttctctaatgatcagtgaggttgagctttttttcatgtttgttggctgcttgtatgtcttcttttgagaagtatctattcatgtcctttgaccactttttaagggggttgatttttttcttgtaaatttgtttaagttcccatagacgctggatattagatttttgccagatggtcagattgcaaaaaatttctctcattatgtaggttgtctctttactctgttgatagtttcttttgctgtgcagaagctctttagtttaattagatcccatttgtcaatttttggttttgttgcaattgcttttcgtatctttgtcatgaaatctttgcccaagcctatgttcttaatggtattgcctaggttttcttctaaggtttttataattttgagttttacaggtaagtctttaatccatcttgagttgatttttatatatggtgtaagggggacttccagtttcaattttctgcataatggctagccagttttcctagcaccatttattaaataaggaatcctttccccattgcttatttttgtcaggtttgttgaagatcagatggttgtaggtatatggtcttatttctggactgtctattctgttccattggtttatgtgtctgttcttgtaccagtattatggaagacagtgtggtgattcctcaaagacctagaggcaaaaatatcgttcaacccagcaatcccattactcggtatatacctaaaggaatataaattattctattataaatatacgtgcacacatatgttcattgcagtaccattcataatagcaaaaacatggaataaacctaaatgctcacaaatgatagactggataaagaaactgtggtacatacacaccatggaatactatgcagctgtaaaatgaatgagatcatgtccttcgcagcgacaaggatggagctagagaccattatcattagcaaattaccacaggaacagaaaaccaaatactttgtgttctcatttataagtggaggctgaattatgggaacacatggacacatgcaggggaacaacacacactgggacctgttggagagttgggggttgagaggagagaaagaattaggaagaatagctaatggatgttgggcttaatacttaggtgatggaatgatctgtgtagcaaatcaacatggtacacatttacctatgtaacaaacctgtccacatgctgcacatgtaccgctgaactgaaaattaaagttgattatccaacaaaggactttcctggagtatcacattggagaatgtttaatcagatatgaccagccacttttaaggaactatagttgactttatggatccaatgctgacaaatctctcccaagtaagccagcctcttatctggcttatgtggtctagcccttagaagtgctaagaaagatcacatcctagcaagccgagatccttgggatattttgtggactttgagaaaataaaatattacattaaattatagatacctaaaggagcaatttgatgaagagagtttcttgaactaggatttctagattaggtacagatataaaagtggcttttaaatgtctgatttgagattccttatgaaaatttttaagaaggttaaggaggcttagatgataaattaactttttcctttccttacatagataatgaggccaagtttaatgaaagtattgttttgtggtcaatattaatctttctttgagatgattctttttaataaaaactagaaagactacagggaaaagttgtgttttgatggaaaagtatgcattgcttagagcacacccttctgggttatctgattccaaacagatggggaatttgttctttcgttgcctttgagacattttacaactccgtaagttttattggttaacaggaatcaaagtaattcatgtatggagacacgtaactaaattctgtctcatagaggttccatggactttcttctactgtggaagcatccattcctatacttatatgcaaattcacatcaacattcctcctatgactatgtctgttctgtgaattctccttctaagtagttgtagcatttgccacatttcctcacttaaaaaataaattacatgagaacatctttaatggattttttataccgtttaagcaccatgatttgcctttttataaaaattaagtggtttacatttttgtatgggagagagaaaaaatatgtacagtacaatgagttatgcattagtgttaaaaattattcatgacgctttttaagaaaccttaaggaagactttattcatggagactatgacaatagctatgggggtgactactacagtgtgctcttacaatagggaaaagagattagactcaacaaatacagaaggaaaaggaggactttatagccaaaaacagagcagtgatgggcaggaggagttggtgggtagaaaattgctaagaggaaacatcaggggtatgggtgcaggtgtactctggccacactgctctaacagcttgccactgccatcctcactccactatccaccagggtgatcaggcatcatcgggggaatggtagaggataaggtgcctgattcgatatctccagtgattagatatggagggtgaatggctctggttaaactgatttagcaagattcttgctaaattgaacaatacagagataaacacagaaatcctaaagttgaggctagctaagaagagagttcagagatggctgagtagaacttggtcaaggtgagactctctgtcatcaaccctcttgttcaaggaaataagagagattcttctttagtgtgaacaacgttagttcattttcttagtcgtctttttttcatcaaggaaacgctgtcttatctgttacgatgttagtccattttgttcattaaggacaagctatcttatctgttgagactttgtagtcaaggatatttgctggatggtgcaagctgtcaggcctttaatgaagggaattcctgtgaaagcttttttaaaagattgatagttgaaactctcagagggcagctagtagggatttctacctgttgagctcaatgtatctttagatggtggagtgaggatggcagtggcaatatgactaaaggttttgtttgcatttgcaaggcctctagtgatagtgtcaggtgatttggtaaatttctgagtggttcacacaccagcaggcaagaagatatactttgaagtttataacaagttgtccagcttcagcttaaaaggtttggtgaaaggatagttttattctcagtaatgccaagtcagaagggtagaagaaaaattggaaatattaattgggagagttgtagtcagattttagaagaaagtaaaagtggtactcaataagggagtactgtaatttcccagtgaaacaaaattactctttatattcagctctctttacaattcttaatcacaaaaaagtctggtctcattagatttggcttaattatttatgtaagtgcagcaagaatcgcaattaactgcaaaggccttatacgttttctttaccgaaacttttcataagaatctcaaatttgattttaaatattctttcaaggccaagaagccaagccaagaacttaccaccaaagttcatttgcaatacctagagatttgtgtgaatttattctcttcttgaggtccccaagatattctgaggttcctgtacctaccagaaagggaacttctttactgggaacggtgtaagccaggtgtcaggctgtttttttcctagaaggctttattaagctttggcttcataaagtcaaccttgcttccttatatttgattctaagtacatcattctcaaacataatattgtaaccaaaactttgataataaaatcagttttttcaatggtgtcctgttacagattctttttgaacttatctgataactattttacaaagatataagaatagtcaataaaagtttccaaattttgaagggatcaggtagggagaaaagaaaaatgtttcatatttgtttacagcacataatctactaaatttctgtaacttacatattgcttgagagaaaagggaaaggggattcttttattcagaaaataggacattgaaagaatcagcagtgtttcaaaacaaaacccctaattattctttatgagttcattcagtcccatgtaatatattttgttttgcttggttttatgttagcagtttcatgaatccattcagttctaaagatccaataagagttagcttgacaagatatttggttgcttctgtgacacccaacaaaaataatacctggaattactgctgatagcattatattagagcataccgtaaacagaaaaataattcacaaatttctattaactttatatgattgctgaaataataacattttgacaatacaaatataacctaggaaaggttaattatcttttttatttgacaatgtttccatgaaatttagcaagcaaaataaaccaaattattttttaacttttctctacatggtgaaagaacaaatcctttgagagttttcagaggccctctgggaaatctcaagatcaattcaagaacaagaagatttcatttaggatttgattttggaaaggcaacattttcaaaaataaaaaaaaagagttattttaaaagtgtgaagacttgattctcttaaataattattttcttaaaataatctcttaaatagtctttatcatagcataaatagcataaaatgtagcaaactattctgataagacacagaactttggttttctagtagattactaaaaaggtatagaaaaacacttttacaatttcttattaagagcagacaaataatccatgaaagtttgtcatttttgtcttgcatctgtataattttgacattaaagataattaataaaaataaataaatccacttacatatttagtcaacttgaccacacataaaattcctctttacaagcaatctatacctttgaaaaatatccatgtgagttttcatttcctcattcaggaatacccagtcatactttagaatgaaattactttagaatacaattacctttttctttcctaaacaacatcatatctttcatacttcatactttttcttcttgaaaacacactggactttccttaaatgttttttaaacagagttgttttccttattatttaagtagttttgtccacatacattgattataacttttaaccatcagtttctttctttacagagaaaactataacagaaaatagacaaatgtgaattgtcataagcccagattcggtaacaggattgcaaatttattaatacataatttcacaatttctagaggcatatacttactcatagaacaatttttcaatgtgacaaaaacgtttattaatgaactcaagtataagtaactcatataaaacatataacaataagatgccaaaagagtgtaaacttaaacttatgcttagtaatgaatattgtactagtttatcttattagaaatgacctagatacttaacaaatatctattattaatgaaacttagcctaacattaaggttgcaagttactaaaatattctggaaattatttcaaggtaaacataacaccaaacaaagctagccattatctcatatctcaagtaatttacctgttaaccctttttatatgacaggcatgttaggtaaacattacaaaagtagaaacctaaaaagttagatacatttttgtttatttttgtttgtttgttttactgctgtgcttgacatacataaagtatttatattaaacaattaattttaactgcatctttactcatgcacatgttcctaggttgaataattttcataattttaaacatccagtagatatactattaccttactcaacttttaaacccaagtaaagtaaaatatgctttttattatgtttaatgctgataactcagaagatacaagggtttttattaagcaaacgttattaaactaggctcacttgccaaagatacgcctatgtcaagtaaatttgaaaataattttgtttagttttttcctaggaattttaggaatatttcatttacaggcactcactaatctgcatgccaatttgaataaagctcctttaaggtattttataaactaatttggtaatactattcagaagtagaaaaatattgcatctacataacatgtttacatgaatgcataaacacacagacgagccacagagatcttatacgtttcattttaaaattcttagctatgagttagtaaagcatagtaatacaaaaaactcactggtttatataaagtagttcttatctttaatacaatttatatttctgtccaaacagtatttttgacaaaaatggaataaattgaggttactgactcaataaggtctaaatctttttttaaaccagtatttatggggaattcttatgattttcttttgttctgatatataatctgacagaagctgtgggctaccttttaggcaagtgcctgaggaaacatcaagcagcaatctggctgtttccaaagctcctctgagtggataaaatatccagtctattttcagttaaccctttccccctctttctgcctcagatgattgctgtttggggttcctgagcaccttgaaagctcttgatgtgtacagggagttcaagtgagtatagagaggtgagccacttaagctgaggtttattgtggaggctgtggtgaggctattctggggatggaggtgccaggtgggccagtcatcagtctccttaggggcaagtgctagtgcacagcagttccttcttggtattaagtaaggttgtttttagtggtgctggtgagaccaaatggtctgtccttgaacccttgggagtgcatttctggtggtggctatggcagtggcagacccaggaaagattgtcctcaggtcatcaggcattgtgcaccggtgccagtggtggtgatatcagcaaaggccctagatgggctgattctcaggccccgcaggggcttatggtgctggtgccaccctgctttcaaaatggtgccatgatgcaacagcatgcggcctggggtgaagggagtgaatagacctggtggagcacacagtcggcaaatattcaagaagggaatttcaattgactgagaaattcccattaggaaaagaagaatcaaatggaagtaataaaacgttctcacaaaccatcatgaaaaaaattccagctcacaaatcaggaaataaattttaatcaaaataaggatccaggaagaacacataccccaaaagttgaggaataatccccactcaagacagagccaggaagaaagacttccagcccagcagttacctgtcaaagagagaagcctgaacttgggcctctaactcagtttctgcttacctgggattgtagcacagcttcttgagtacacacaaaaccttaagaatcaaatctgtccttactatcattcaacaggctgtcaaaagtgtgtacacagggtcctaagtgaaaagtctgggggtccagtgatacatgtgatcctgagtcatggcacctcaaacattaaagaaaaaattacttatgatgcttaaagaacagtaagaaaaactttattaacagagagtaacgtgatatgtataggagcttgttgtagggagagggattgggctcaactctaaatgaacagtgaaaagtaagaatgtatggaaaaggagtaaggttggggacataggttactaagtagaaaattattaaaaggaaacatcaagagtagggaagattttggcttagtctgttttgtgttgctgtaaaggaaaatgtctcagtctaggtactttatagcaaaatgggtttatttggctcacagttctgcagactgtacaagaaacatgacaccaatatctggttctggcgagatcctcagaaagcctctactcattggtggaaggggaaagggagaaggtatcacaggcaagaggaaggaagcaagataaaacgaaagaggaagaagtagccaggctctttttttaacagccagatctcacaggaacatagagtgagaactcactcaatcctgcaagaatggtaccacgcccttcatgagggattcacccacatgacacaaacaactccacactaggccccatctccaacattggggattaaattttaatatgagatcaggaggggacaaatgtccaaagcatgtaattgacctaacaggattcttgctatcagcaagccagaattatcacatatcaagtgggaatggtagaatatgaggaaatcaattaaacatctagagtaaccagatatggaggggaaggggctttggttaaactgacctagcatgactcttgctaaaatcgaacaatatggagataaatatgaaaatcaaggccaagttgagaacacagttcagaggaacctgggtagaggagatagtctttgtcattaggtagaattcccattgaaatgtcaaagacaggaatctgtcaccttagaaaatgacatttcatgttaaggaaggagatattgaattaaataaaatgagtaaataaagcattgtttattttatttttatatttttcatgtatgcatgttagtttttttgaata

SEQ ID NO: 238 - DNA, 22511 bp, Homo sapiens
accttcccataaattcttttaaactatgtgatgattacttcttagttgccaattgcctactgtttgcatccccaatgaaaataagccccacttggttatgttgtcaagaattctctccttccactgttgctttttctcttagctttctccaggtacttcttattaaagagatagcagaaagtttgtgtatgtttgtgtgtgtgaaaattgctttgacaaggacatgtgctcattggctcaatgttcatgtgttcattggctcaatgttcaactttgtggaccaaatcaatttgtttcatgacaatttaaagtaagctacagtaagacaggcagtgcattactatcatggtggatggcatatagtagcttattaaatacttgttgaatgaataaatgattgtattttttaaactggcatcttttttatctttattattatttttcccattgtgctacgtttgctatgaaataaaaatatgggttttagcaattgtaaaaactattctcaaggatttttacattgtaatctagtattaattttcaacttaatttacataatatgttttaaaagtgttatttatgtacaaagaatattaatatacagctataattataataataaaatgaggcatgtatattaattattaatatctcattctagagacgtgaagtattgttcttgtaaaaaacaaaatgttgcaaatcagttgaggtttctcttggccccatatactgaaataatagtgaaggggggcaaatcatacagatgagatacagctaaagcagttcctatacagaaaattataggttaaatttatttattaggaaataagagttgaaaaatcaaaaaatgtaacttctatttcaagaagatagtgaaggaataacaacaaaatctccaaaaaaatgaagaaaataaactggtaaaatcagaaatgaataaaatagaaatatgatataaaataatgtcatcaaagcagaaatttcattccttaacaagttttaaaaaatccataatttaacaaaactgaaagaataaagagataaaacactaaacttattttaatgtataccatttgaactaatgtatgtatacccatttcagggtatacatacccatttcaggtacccagaatatgccatttgaactaatggcacttattccggagtcatgaaaattttacatttcaatctttatggtaaggcattagaatcacccagggagctctcaaaagttgtgatattcaggttcacttgatttatgacagtgacacaattctataaggaatagatggtatttacaatagatagagcaatttaaatgcaagtagaaagaaagaaatcttgagttttatcaaaacattaatttgagttggacaataggcctaagtattcaaggtaaaacaaaaaatcttgtagaaaaactatggtaatattttcatgatttgggataaccatggatacaaccaggaaaaacaaatttcatagacagaattaattaatagaaagcatttccatggaaagacctctgggaataaataatatcatcatatggaatagtactcagccttaaaaaaaggatgaaattctgtcatttgctacaacatggatggaactggagaacattatgttaaataaaataagccaggcacagaaagacaaacactgcatgttctcacttagatgtggaatctaaaacaattgaactcatagaaacaaagtagcatgatgaatactagatgatggggatggggggagtctggagatgatagtcaaaaggtaaaaagttagaaagaataaattcgattattttataacaatagcacagcatgctgaatatagctaatatttgagtcctctgtatttcaatatttctaagagtaaatttctaatgttctcatcaaaaaaaaatattattattatatatatctgacaaatgatatgtaaagaactgcaaatgaataagtaaaattcagtaaaaaataggcaatgcacttgacttgcactgttcaatttgcatttggaaaaatgcaaattaatatcacaatgaggtattatatcatacccattagaatggctaacatcaaaaagaataacaatcccaaattgtggtgaatatgtggagaactagaatgcttacactttgctattagatgtgtaaatcagtgcaagttctttggtgacaaagtttagcattatcttctataggtacataaatacctaccctatgacttaaaatatcatttctaaaaaagttagttcctgtttcaagcaaacacattctaagaatgtctataggaactttatcatattagccaacatttgaaaaagactctaatattcatcaacatgtgaatgggtaaaattgaattaggtattctgatttaattgactatgatgttaacctgaatatcacaacttttgagagctccctgggtgattttaatgccttaccataaagattgaaatgtaaaattttcatgactccagaataagtgccattagttcaaatggcatatttctgggtacctgtctgtctttgatggcttgatttctccatgagtcacaattactgctaggtacaaaggtacttaatcactgatgcagaataatgtatgctttttaaagtgctaccagtgaactctctccaggctgttacataaactgatttcttagattatcatttagtgatcattttttgtaaataatatttttgttattattgtttctcactgaagtgattctgccattattggctgttctagtagataaatactgggttgttaggtttcttaaaaaataatttttatgttgtttgttcctgtctgataccatttctccaaactttctggaaagagaatggccattttaatatatcacagtcacagtgataggggttgtggcacagagattggcatatgaaccaattgcaccagtcacattaagtttttatccttggtatactgattacttctgcttagaatattaaggaagctattaaacatttttcttttaagtggatctgagagtgacagttctctctcctctcttcattgagagagaaaaagtgctctactgcctatttgtctgcccacgatttagcaaactacgtgggttagttttgttcaaaacacgtatagaaacaaaacagagagctgaagcatgtaagttagcggtgataacaacttctttgcagcacttaagtgtcctgtagctcacaaggttcctacaacttttaattcaagtctgtctgctgttatgatattttacctcagaatgtttacgtttctttaagataatattgggtttgctgttgtttgccatgttcttcatttcaggaacatgtgcaaatcattatgttcaccataaatcatcacctcccccataggcattcatgtatctgtattttatttttcattttattttattaagactgcccaaaaccccaaaaatacagattatctttgagactcttgaatgagacatctatgtacaatatcctgaaagaataagatgcttattaaagccaactaattgctcctcatcttgttagtggaaatgaagtctttatattgagctgcctatcctcaccctgagagaataggagcttctgtttctttcaattaataaagcatgtcaactactgctttgttgtactacaaccccaaacccatatctgtatttgtaagactttggaaaaggcagatggatatagttacgcaccttgaacacagaagcagttcttgccctgatctgataataggatttcctatactaggacaggtttgtgaaaacatatgtagttctgaatttaaaaactaaaatgtactcaagataatactatcctggagtatcagagattaggtttgaatcccagcttttgatttcctctctgtgtgagtttcataaaatcaaactctcagagcctcaatctcttcaactaaaataaataagaaaaaaccctttataaaaagctgggtcattgtgaaaaatagcttttttaaaatgcctaaaaatacctggaagcacatcgtgcatgtattagaggtttgaaagcaatacttgtatctattaaaattttccattaattgggaggtactgtcagctgtgggctgattattttttttaagcatttgacattcctggaaggtgtttcttgatttacctgaggatgaagtgtaggagacttgaactggcatggttgatggaaatgacttgattcaacgagtgggtaaaatgaaaaggctaaagtggttttcacaatatgcaagattttgaggtcatagtgggaaggaaagttggactatttttcagccacaaatctaaagcaataaatttctctttgtaccatatcttttttcctgttttaaaaatctttagcatcaatgatacgcctgtatttgaaatagacaatttaagaaaattgtatcctaccatgaataaatattactaaactcttcagagagcaagtttttctacaaacatggtcttatttttaaaatcattcattagcatttatttattgaactctactcttcatcagaaatgttctagacattaggtaggaaaaattaaagaaaatagataggtttcttcaatcgctcataatacactttattcaagaagtagaaagaaatgaaataagcacaaaagttatctataattgcaaatattaagtataataaagaataaagaataaacaagtaataaaagagataaaagagagggtcataatacaagcttgggctaggtaatttatgatgaaattaagccaacatttaaagaaaaaagaaaaggaatgccttacacaaaattggtgtcaagcattttaacaaaagagttctgatgtgaaaactcacaggaagaaaagagctctgtaaattcaaaaacgattcagtaggtcaatgtggctggagattaatgaatatctgatgatgttgaacaagtagaaagggtccagctcatgtagggtctcggaatatgttcttccttcggcttggcgtgttggctcacgcctgtaataccagcactttgggaggccaaggcaggcggatcacttgaggtcaggagtttgagaccaacctggccaacatggtgaaaccctgtctctacaaaaaatacaaaaatcagccaggcgtggtgacatgcgcctgtaatcctagatactcgggaggctgagaggcaagagaatcgcttgaacctgggaggcggaggttgcagtgagcagagattgtgctactgcaccccagcttgggctacagagcaagatttcgtctcaaaaaaaatttctttattgatttaattgtatttctaaagaagtgagagttcaaatttaaaagaggcactcatatattcagtttgcctttttaattactcttgccttgcatagcgaatcttttataaggcagggaacttagcaatattttactgaagaaatgcttggtgacttctagggtggggaaatgatggggcggggattggactgaaaaactatctgttgggtactatgctcactacctgggtccaatacccatgtaaaaatccaacccatatcaaatataaaagctggaatttaaaaaagatggtgacatactaacatgattaaaatggatagagagacagatataatataaaatttgggtctagcagtaaaagaacctggtatagagagactgaatgtagataacgaggaatccaacttctgtcagaactgtaaaaattatcgtttttctgtcttggttgtaatttgttgtttgtatcagaggtgctatcataagacatttatttttattctgcttaactgaaatggggacataaggcaacgtacttcctggttacagttttattcccattctcagtatctagagtgaataaaataagtctgtgataacgataaaaatatgtgttgataattcttggtgtcaaatattaggtttctcaaatttaccttaaatatcttaccagacatttccaggttttctgtcacatatgactgttaaatcttccattgacacaattttgctacaactctcactctaatctgtttagtttttacacaataaacaattggtttcatcagcggaggtacaagtaggagaacatttgccatgagaacattaatgaggggagagacatgcccggcaaagcggtggacaacggccaggttgatgatgggcaggtagaagatgatcactgcacagatgtgtgaaacacaagtattgagagccttaagctcctcctttttggatgcaattcccggtacagtcttgaggatcagggtgtaagacacagcaatgagaataaagtctaccataaggcagagtgctccaaaaaagccatagataacatcaattctgttgtcagaacaggccaacttcatgacatcctggtggagacagtaggaatgggataattggtttttcttgcaatatctcaagcttcttaaagtgaaagggaagggaagaaccaggagcatgctcttaaaggagaatactatccctatttgggcaactctgacagttgtcaggattgaggtgtatctcagaggattgtggatggctaggaatctatcaaatgacatgatcaggaggactgaggactccagtactgagaatccatgaatgaagaattcctgggcaaagcaggcactagaagaagtttcaggggcattgaacaggaagatgcttaacacagtgggcagagatgataaagacaaacccaagtctgacatagccaacatggaaagaaaatagtacatgggcccatgcaaggagggctctgtcttgatgataaaaagaatggtgccatttcctagaatagcaataagatacatgctgcagatggggatagagatccagatgtgtgcatattctagccctggcatcccaaccaagaagaaggtggtgatttcaacatatgatgtgttgataatggacatgattcattcatagggctctgctatgaaaaatacagatacacctgacctcaggtgatccgcttgcttgtgttggtaaaataggcatatctgtaaatttagtagaaaaaaagcagtgttaaaatttgtggcttctttcagctttcttttgagagaacaaagcatttatgtggctatcataatgaagagagatgggtaatactttagagtagaatctgtctattaatgcattgggaaaattatttctggacatgttatttctatagagaatccaggtttaaattttgcagttagttacacgtctgattttatttttcctgtaaaatatgagtaaatcctagtgaattaactggaatgctatactaattctttctttcagatgtatgttgtgatcttcagttctatgtgatcagttgccaaaaaagaagtcaagtgaaagccaaataaatgagaatatctgggcacttaccagagagtggatattttggcgggcatttttgataaaagctaaagaatcctgatatacaaacccaaggcattgctgaatttatctgccacaaaagactgctcttattcacttttacctaaccagtggctctcgggtcacagagttctctggggattgcagccagggtggatcttttctgaaaattggaataaacatttgtagatacagtaaatctacagagatagttgttaccaaggaaactaaaacaacatctagtaacacctgtaataagggatgatttgtttggagagaggtccttaattggcaggtattagagagacatggtaaattctctgcaaaagcttggatatttctgaatggatagttggcttgtgtatttctcctctgcacaaggccaagtctaagcagagatgctatgagttgattctgcattcaaggaagtgttgcaggacaaacatcctgggacacaatgtgttatcctagattttattcctgaatcctggatccatctccccggacccattagacatcgctaactaaatatcccttaaaaccaacttgtccaacttagacaagtttttctcccttaccaaatcttcctagtttaagggacctacttcagtaataagcctttaagaatttgcaagccaaatatctgagattctttgtcttacattttgtacacaataatgaccaatatttcttagaaaattaaattgttttacttactgagttccattaccagatgatgatttggaatcttgaaattttttaaataatataatcaagttatatcattatcttcattttactgatgaagaaaatttttctcaagatcaagtcgtctgtttaagatcacagaagtgttgtagggtagaggtaagatagcaactcaggtctgttattttactgataattaggtgtataccacactgtcaggatggtcaagcaatatttaaagagttatgaactgaatgtagctcgtgagaagtaaaaggcaatttttaaattaagatacacacatttaaatataaacaatgcctgcctgctgtttcatactggcataaaagcaatttttttgaagaaaatgtgtttacatcattgtaaaaacataaacattccaaagagttaaagaatatatttgcaaataaaagtaaagttaatctatatcttctgctttcacaccaatttgtagaaaattggcattattctacaaagggcatccaggtcaattgctcatcataatgccttattcttttttcctctttctttgtcctcttgtaattgggcagcatagcttccaacttgttgtaaaacttttttttattcctttcgtcctttcccccgatgagaaaaactgcagatgtttttctcttatcttgaaatacagcctgaaaatgaggtataaaactccaccttacactcccacaccttatgcacatttgttattctggttgcctgttaaactcacactatgctcatttatcacacacacttctgtttttttttcttttttttttggagatagagtctcactctgtcacccaggttggagtgcagtggatctcgcctcactgcaacctccatctcctaggttcaagcgattctcctgcctcaacctcccaagtagctgggactacaggtgtgagccaacacccaagctaatttttttgtatttttagtagagatggggttttgccatgttggccaggcaggtctcgaactcctgacctcaggtgatccgcttgcttcagcctcccagcatatatttccttagaagcttcagaggcttaattttgacacaactaggcacctccagaattgtcttcccagcagaaaattactccaaggccagaattcactcccaacaagagtttaactgtgagattaactgcaattaatttgtaatctggttgggcccatgatggcgccagctccttcactagatggaacaataattcaagataagacattggagcaagtcacagcagctggcacctcctatccccccttcctcttctgcatttcaatcccctcttcttaaagcccttgtgctctgtccagaatttggaaaagtgacaatttttcgaaataattcctgccgtttttacctcttgctagcgcgaacaataaagctcaccctttttctatcgtatctcactctttttattttttgcttctttctagaagtagtgagtagctgcacccttttgctggttacaatctcatatgatgcaagagtcttatttattttctatagaacaagttcagatttttctattgttgattctttcctaatattcttaaaatctcataatgccttactctgcttctctcttttcatatctatctatctgtctatctatctatcatgtctctatcaaccatctatcttctctatcatctatcatttatatccatctatcatctatctgtatctatctggtttgttaatttgtatttttctttctcctgtatcttttctcttttctctaacttaccatctataacaatatatgcctgctgtgtttctgaggtgctattcctgtagttacgcctcttgagcttttgaattgttttccttgaattaaactacatttcctcaggttgaatcccttgcttagtttgatttctgtctctaagttgcttatcagagggttagtaataaacatacccacaacaaaataaagttttgaaggagatgaacaagaaataataggataactagcagagaatacagaggaatttctagatccaattaacaaatgcagaagataggccgggcgcggtggctcacgcctgtaatcccaccactttgggaggccgaggcgggcagatcatgaggtcatgagatcgagaccatcctggctaacacggtgaaacccagtctctactaaaaatacaaaaaattagccgggcgtggtggcgggcgcctgtagtcccagctactcgggaggctgaggcaggagaacggcgtgaatacgggaggcggagcttgcagtgagctgagatctcgccaccgcactctagcctgggcgacagagagaaactctgtctcaaaaaaaaaaaaaaaaaaaaaaaaaaatcttacaagatttcactgaatttctattacattgcaatttggaaggtacttaccacaaatatcaaaggaggccattatatccacagttgttacaaaatgcctttgtgctgggtataggatgtgtcttcctcaaatatgagtttgaccattctgtcttctcttaataaaagtcagaaaaatcttccaagtcaactctcttgattgaaacacaatccctgccctctcttctgctaggctatacacactttagcctctagaatgtcatcactccccctacttaagtcctctgttgcacgggtctattttcccctgaacacaccagaaagcatcttgcttccataccattgcttcagaagatgatctgaagtaaagtgtgcagggaattcatattatctctttaagtggtatccagttcaatcatttattgtgttgatttattttcttttcttgtcctctattgccctcacgtatgttacaagacccttagaggtttattttgcatataatcagccctaacttgtttattgttgactgttttctaaatatactcatactctcacaatacttttctccattcctctttttcttgaatgtgtttgtgcctgtgtgagtgtgtatgtgtattcatttttctcctatatcttttttctcacctttagactcacaatccataaatcaaaacatatggctgctgtgcttctgagctgttacacctgtgaccacttctctttgagtttttgaaattttttcactgaatttcatttcagccccgcccccccacccaggagaatgccttgctgagacttctgtctccaagttggctattagcaatttagtaataaatatattctcagcaaaataaaattttgaagcaaatggacatggcataatgggttaaatagtgttgaacagaaagaaaattctaggtgcaattggcacataggaagaaaataaatatcttaaaagcaattgattgaatggtgactacattcacgtttttggatagtacttaaccactagtatcaatggagctcaaaaatgcctgtgtgctatgtgcctgattttttttttttctgtaatgttagtttgattattctgtcttaagaaaggtcatgatgccccactccacctcaactgtcaaacatctttattgacatgcaaagacctgctctctgcccagtcaggctagacaaacatccagcctctgtaacatcattcccaccccccacccacttaagttttctgttgctgctacgtgggtctattatctgctaaacacatataccataaaacttcctttttccatactattgcttcagagggtgatctgcaattggatctgatcataatcctgaaagaaataatcctgattgctgaaatctcaaaatatcaaaatctccaaagtccaaaactccaaaaattacagtaccaaaaggccaaaatacagaaaatacatttctgaaaaaaatatttaaaatatatttatttacatttaaaaaggggatttatttgagaaatataaaaagcatagcagaacatttcataagccactttacacaataaaatatataataatgacatacatatttttgcaagcataaatgcaaaggcatatattaacaacaatcacaggggtataatagttactgagcaaacaaacagtatacataaaaagataagtcaaaaagggaaatgtataaatgcatgaagctatagtcagtaattgtatgcactcagctttataactgcaattatctgaaatactgttttgagcaacctaagccttttgatgagatcagtcaaatagtgtgatgagtcatcaccacatatagtcacctaaagagccgagatctcaagaaattttgtcttcacaactgcagatgtacctaaaggatatttcttcatttaccaaggaagtttcagtgtttctacatacacgcatatgtttacacacaaagtcaattttgtgataatgcattttcatggagttaaatttccgatgtccaagggagcagtagaaaagtctgtcctagctttcagtaaaagactaatttggcttctgtatctgttccctctgggcccctggctgattcgatggtgcccagcaacattgagggtagatatttcccacccagtcctcttacacgcacacactgatctcctctggaaataccctcacggacacatccaaaataatattttaccaggtttctagctattccttaatccagtcaagttgacacctaaaattaagtccacaagttcaccccttgtcaatttggcaaccataagcatctccttaaactatacttcatttccaaataaagacaataacaaagtaatagtttcatctaacatgatgcaaccgtcctgcagacaggcaaaaatgtactaatgtactaatctattcttcagaatttggctttcataatttcaacacttgggattttaatttttgggagattgcaatttttgaggttttagatttcagggatatgaacattaagaatttttaacttttgggacttcaactttctgaattatggtattcgggattgtatcttttgagattctgacccaaactcatctgaaatgaagtgtgcagtaatcaatgaaaaacagtttcaaggatacctgtctataaataatactataaatcatttgcctttaatatggaaatacatagaacagaattggcattttcaacattataaaattggagcaacccctgtttttttctgctgcttggagtgctgtgtcttttgttttttgtttttgtttgtttgttttttgtatatttattcctatcctatctgctggtaagcacaaattaatcctcaaatccttggtcaagttctagatcagtagtggaagcagcggcaactcagtgtgtagtgtgctccttgataacattgctgttttgtctcctccctctaaagtctcagaatcacatataagcagatatcattttacttacactaaaatacactgaatgaattaaaagtcctagtctcaatttggagacctctgtatttcaattaagtgattacatgaaatgtatataaaacccactctcacaacattacttagaacttatgaaattatagatttttaggagagtcataaggttgctttcttatttatcaatagaaaaatatatataaagcaaatatttaaacctgattagaagcgtgctgggttaggacagatgatagaggcagaaactcctagtggtcactgttgctttctcacagatgcccattgcaagctcagtggtttcacatatctctacccccaaacaacttatttcaacgtgtaaggcagtaattctataattcaggaaaatgttacctaaaagccagatccaggtacgggattttaatttttttctgtgttgaaatagtaattcgggtttagcacttggttgatttccgaaagttggcacaactctggacttcgatcctgcatttacatacattgttggactttttgacaagttggggtactggcatgcattttaatcacttggagaacagagtcaaacaaaaagcatgtgaacttctgggttgagctggtgcaaaggcaaagtagcaactgtgacattagtaagctaaacagaaagttgataaatagttgagcccacatgtcaaagtacaggggaaatagaaacagaacacacttaccagagttttgctgctgtgtaaatgtaagaatttatcctcatctgccaagtctcatcctgcctaacagatgctttcccattagccaagaaagccctggggattccaactcagcagaatgtacttaaattcctatctaccaataatagacaaacagagagccaaatcatgagtgaactcccattaacaactgctacgaagagaataaaatacttaggaatacaacttacaagggatgtgaaggacctcttcaaggagaactacaaaccactggtcaaggaaataagagaggacacaaacaaatggaaaaacactccatgctcatggataggaagaaccaatatcatgaaaatggccatactgcccaaagtaatttatagattcaatgctatccccatcaagctaccattgactttcttcacagagttagaaaaaactactttaaatttcatatggaaccaaataagagcccatatagccaagacaatcctaagcaaaaagaacaaagccggaggcatcatactacctgacttcaaactatactacaaggctacagtaaccaaaacagcatggtactgtaccaaaacggatatatagaccgatggaacagaacagaggcctcagaaataatgccaaacatctacaaccttctgatctttgtccttgctttttatgacgtgttatttacagaggttcaataagaacctgacttcttttgaagcatgatacaatttgaaagattgatacactgtcttcacaatagttgaactaatttacactcttaccaatggtgtaaaagcgttcctttttctccacaacctcaccagcatctgttggtttttaattttttaattatagcaattctgactggtgtgagatggcatctcatcgtggttttgatttgcatttctctaatgatcagtgaggttgagctttttttcatgtttgttggctgcttgtatgtcttcttttgagaagtatctattcatgtcctttgaccactttttaagggggttgatttttttcttgtaaatttgtttaagttcccatagacgctggatattagatttttgccagatggtcagattgcaaaaaatttctctcattatgtaggttgtctctttactctgttgatagtttcttttgctgtgcagaagctctttagtttaattagatcccatttgtcaatttttggttttgttgcaattgcttttcgtatctttgtcatgaaatctttgcccaagcctatgttcttaatggtattgcctaggttttcttctaaggtttttataattttgagttttacaggtaagtctttaatccatcttgagttgatttttatatatggtgtaagggggacttccagtttcaattttctgcataatggctagccagttttcctagcaccatttattaaataaggaatcctttccccattgcttatttttgtcaggtttgttgaagatcagatggttgtaggtatatggtcttatttctggactgtctattctgttccattggtttatgtgtctgttcttgtaccagtattatggaagacagtgtggtgattcctcaaagacctagaggcaaaaatatcgttcaacccagcaatcccattactcggtatatacctaaaggaatataaattattctattataaatatacgtgcacacatatgttcattgcagtaccattcataatagcaaaaacatggaataaacctaaatgctcacaaatgatagactggataaagaaactgtggtacatacacaccatggaatactatgcagctgtaaaatgaatgagatcatgtccttcgcagcgacaaggatggagctagagaccattatcattagcaaattaccacaggaacagaaaaccaaatactttgtgttctcatttataagtggaggctgaattatgggaacacatggacacatgcaggggaacaacacacactgggacctgttggagagttgggggttgagaggagagaaagaattaggaagaatagctaatggatgttgggcttaatacttaggtgatggaatgatctgtgtagcaaatcaacatggtacacatttacctatgtaacaaacctgtccacatgctgcacatgtaccgctgaactgaaaattaaagttgattatccaacaaaggactttcctggagtatcacattggagaatgtttaatcagatatgaccagccacttttaaggaactatagttgactttatggatccaatgctgacaaatctctcccaagtaagccagcctcttatctggcttatgtggtctagcccttagaagtgctaagaaagatcacatcctagcaagccgagatccttgggatattttgtggactttgagaaaataaaatattacattaaattatagatacctaaaggagcaatttgatgaagagagtttcttgaactaggatttctagattaggtacagatataaaagtggcttttaaatgtctgatttgagattccttatgaaaatttttaagaaggttaaggaggcttagatgataaattaactttttcctttccttacatagataatgaggccaagtttaatgaaagtattgttttgtggtcaatattaatctttctttgagatgattctttttaataaaaactagaaagactacagggaaaagttgtgttttgatggaaaagtatgcattgcttagagcacacccttctgggttatctgattccaaacagatggggaatttgttctttcgttgcctttgagacattttacaactccgtaagttttattggttaacaggaatcaaagtaattcatgtatggagacacgtaactaaattctgtctcatagaggttccatggactttcttctactgtggaagcatccattcctatacttatatgcaaattcacatcaacattcctcctatgactatgtctgttctgtgaattctccttctaagtagttgtagcatttgccacatttcctcacttaaaaaataaattacatgagaacatctttaatggattttttataccgtttaagcaccatgatttgcctttttataaaaattaagtggtttacatttttgtatgggagagagaaaaaatatgtacagtacaatgagttatgcattagtgttaaaaattattcatgacgctttttaagaaaccttaaggaagactttattcatggagactatgacaatagctatgggggtgactactacagtgtgctcttacaatagggaaaagagattagactcaacaaatacagaaggaaaaggaggactttatagccaaaaacagagcagtgatgggcaggaggagttggtgggtagaaaattgctaagaggaaacatcaggggtatgggtgcaggtgtactctggccacactgctctaacagcttgccactgccatcctcactccactatccaccagggtgatcaggcatcatcgggggaatggtagaggataaggtgcctgattcgatatctccagtgattagatatggagggtgaatggctctggttaaactgatttagcaagattcttgctaaattgaacaatacagagataaacacagaaatcctaaagttgaggctagctaagaagagagttcagagatggctgagtagaacttggtcaaggtgagactctctgtcatcaaccctcttgttcaaggaaataagagagattcttctttagtgtgaacaacgttagttcattttcttagtcgtctttttttcatcaaggaaacgctgtcttatctgttacgatgttagtccattttgttcattaaggacaagctatcttatctgttgagactttgtagtcaaggatatttgctggatggtgcaagctgtcaggcctttaatgaagggaattcctgtgaaagcttttttaaaagattgatagttgaaactctcagagggcagctagtagggatttctacctgttgagctcaatgtatctttagatggtggagtgaggatggcagtggcaatatgactaaaggttttgtttgcatttgcaaggcctctagtgatagtgtcaggtgatttggtaaatttctgagtggttcacacaccagcaggcaagaagatatactttgaagtttataacaagttgtccagcttcagcttaaaaggtttggtgaaaggatagttttattctcagtaatgccaagtcagaagggtagaagaaaaattggaaatattaattgggagagttgtagtcagattttagaagaaagtaaaagtggtactcaataagggagtactgtaatttcccagtgaaacaaaattactctttatattcagctctctttacaattcttaatcacaaaaaagtctggtctcattagatttggcttaattatttatgtaagtgcagcaagaatcgcaattaactgcaaaggccttatacgttttctttaccgaaacttttcataagaatctcaaatttgattttaaatattctttcaaggccaagaagccaagccaagaacttaccaccaaagttcatttgcaatacctagagatttgtgtgaatttattctcttcttgaggtccccaagatattctgaggttcctgtacctaccagaaagggaacttctttactgggaacggtgtaagccaggtgtcaggctgtttttttcctagaaggctttattaagctttggcttcataaagtcaaccttgcttccttatatttgattctaagtacatcattctcaaacataatattgtaaccaaaactttgataataaaatcagttttttcaatggtgtcctgttacagattctttttgaacttatctgataactattttacaaagatataagaatagtcaataaaagtttccaaattttgaagggatcaggtagggagaaaagaaaaatgtttcatatttgtttacagcacataatctactaaatttctgtaacttacatattgcttgagagaaaagggaaaggggattcttttattcagaaaataggacattgaaagaatcagcagtgtttcaaaacaaaacccctaattattctttatgagttcattcagtcccatgtaatatattttgttttgcttggttttatgttagcagtttcatgaatccattcagttctaaagatccaataagagttagcttgacaagatatttggttgcttctgtgacacccaacaaaaataatacctggaattactgctgatagcattatattagagcataccgtaaacagaaaaataattcacaaatttctattaactttatatgattgctgaaataataacattttgacaatacaaatataacctaggaaaggttaattatcttttttatttgacaatgtttccatgaaatttagcaagcaaaataaaccaaattattttttaacttttctctacatggtgaaagaacaaatcctttgagagttttcagaggccctctgggaaatctcaagatcaattcaagaacaagaagatttcatttaggatttgattttggaaaggcaacattttcaaaaataaaaaaaaagagttattttaaaagtgtgaagacttgattctcttaaataattattttcttaaaataatctcttaaatagtctttatcatagcataaatagcataaaatgtagcaaactattctgataagacacagaactttggttttctagtagattactaaaaaggtatagaaaaacacttttacaatttcttattaagagcagacaaataatccatgaaagtttgtcatttttgtcttgcatctgtataattttgacattaaagataattaataaaaataaataaatccacttacatatttagtcaacttgaccacacataaaattcctctttacaagcaatctatacctttgaaaaatatccatgtgagttttcatttcctcattcaggaatacccagtcatactttagaatgaaattactttagaatacaattacctttttctttcctaaacaacatcatatctttcatacttcatactttttcttcttgaaaacacactggactttccttaaatgttttttaaacagagttgttttccttattatttaagtagttttgtccacatacattgattataacttttaaccatcagtttctttctttacagagaaaactataacagaaaatagacaaatgtgaattgtcataagcccagattcggtaacaggattgcaaatttattaatacataatttcacaatttctagaggcatatacttactcatagaacaatttttcaatgtgacaaaaacgtttattaatgaactcaagtataagtaactcatataaaacatataacaataagatgccaaaagagtgtaaacttaaacttatgcttagtaatgaatattgtactagtttatcttattagaaatgacctagatacttaacaaatatctattattaatgaaacttagcctaacattaaggttgcaagttactaaaatattctggaaattatttcaaggtaaacataacaccaaacaaagctagccattatctcatatctcaagtaatttacctgttaaccctttttatatgacaggcatgttaggtaaacattacaaaagtagaaacctaaaaagttagatacatttttgtttatttttgtttgtttgttttactgctgtgcttgacatacataaagtatttatattaaacaattaattttaactgcatctttactcatgcacatgttcctaggttgaataattttcataattttaaacatccagtagatatactattaccttactcaacttttaaacccaagtaaagtaaaatatgctttttattatgtttaatgctgataactcagaagatacaagggtttttattaagcaaacgttattaaactaggctcacttgccaaagatacgcctatgtcaagtaaatttgaaaataattttgtttagttttttcctaggaattttaggaatatttcatttacaggcactcactaatctgcatgccaatttgaataaagctcctttaaggtattttataaactaatttggtaatactattcagaagtagaaaaatattgcatctacataacatgtttacatgaatgcataaacacacagacgagccacagagatcttatacgtttcattttaaaattcttagctatgagttagtaaagcatagtaatacaaaaaactcactggtttatataaagtagttcttatctttaatacaatttatatttctgtccaaacagtatttttgacaaaaatggaataaattgaggttactgactcaataaggtctaaatctttttttaaaccagtatttatggggaattcttatgattttcttttgttctgatatataatctgacagaagctgtgggctaccttttaggcaagtgcctgaggaaacatcaagcagcaatctggctgtttccaaagctcctctgagtggataaaatatccagtctattttcagttaaccctttccccctctttctgcctcagatgattgctgtttggggttcctgagcaccttgaaagctcttgatgtgtacagggagttcaagtgagtatagagaggtgagccacttaagctgaggtttattgtggaggctgtggtgaggctattctggggatggaggtgccaggtgggccagtcatcagtctccttaggggcaagtgctagtgcacagcagttccttcttggtattaagtaaggttgtttttagtggtgctggtgagaccaaatggtctgtccttgaacccttgggagtgcatttctggtggtggctatggcagtggcagacccaggaaagattgtcctcaggtcatcaggcattgtgcaccggtgccagtggtggtgatatcagcaaaggccctagatgggctgattctcaggccccgcaggggcttatggtgctggtgccaccctgctttcaaaatggtgccatgatgcaacagcatgcggcctggggtgaagggagtgaatagacctggtggagcacacagtcggcaaatattcaagaagggaatttcaattgactgagaaattcccattaggaaaagaagaatcaaatggaagtaataaaacgttctcacaaaccatcatgaaaaaaattccagctcacaaatcaggaaataaattttaatcaaaataaggatccaggaagaacacataccccaaaagttgaggaataatccccactcaagacagagccaggaagaaagacttccagcccagcagttacctgtcaaagagagaagcctgaacttgggcctctaactcagtttctgcttacctgggattgtagcacagcttcttgagta

SEQ ID NO: 239 - DNA, 10208 bp, Homo sapiens
actccttcctcagtatgtttccttaaactaaccaataatttcataaaagcagatcatctttcagaaggaaaaactaagggaaatcataggtgggttagcacactccacaatgtaaaggaaacaataaatatacattcccatgcaaaattcaattctctctcttcaaaactaccacagcattttgtgggaccctctagaagagcatttcacctggagtgattcaggcctacctgctcctcagggtctgggccccaccttcatctttctctatgattttacactgtgcctgacagtggtgagcttgcaacttctgtctgaatgaaactgatcaggagtagttctggcagctatttagatagaattggagtctcagcactcattatttatcatactcatcctttaatttaaaagagggccaagaaaaccaaattatttaaagatttcccaatttctgaaaatataatgctgtatcagttgttttttttttaagcagctcaaaaaatagcacatagagcaggtaaaaagggtaggaaaaatttttttctatgcaaaagccttaacatttataaacttcaaccaaatccctataaaaaacatgtagtttttgcactgtgtagtccatatgctaaatggacatgtttagttacatgttttcttgagcagtactttttatttgtagcaaagctattacatcttatacattatattacacgtaaaagtccattttaaaccaaattacttcaaaatttgacctatattacatctggcacagactagctgttctgctatactgtttaaatgcctgctatattcgcagcagttactttataaaacacataatctttatgtgctagcagtaaatttctatacctttaagggataattctaggctaatcaattagtataccaaccttccctatccccgaccccattcattcacttggccctgaccatgctaagcatctgctacatataactcctagtaggaggtacaactatgtagaaacactacaaagttactgtgacagtatttaaaacagatgcactgacagccaaaaaaaaggggaaaaaaatcccatacaaaaattgtgaaaagagttaagatacaaaagaaaaaaataacagtaaaatagcaagcgctcaatataatttatgtcaattttgtaacttttcttatttatacacaagatcaaggaaagaacagaaaatccttttataacaataaaacagtgtaagagacagaagcatcgtaagtcaaagctaaaaaaaagcaaccaattattatatactcattacaaaataatacactgggaaaaggtcgaaactgtaattggctcttataaagtagtaattcaggatatatacagtctatgactgtaaagcacatctttataatacaagtagaacactttcatacagtttccaacagaagggtttattcataagccattactgcagaggaaaacaacaacagacaaatcctcaacctgttaataagttcaaactgtttgccaattcaactgggaaataatgcattagaaaaaatacctacttgttaacaaagtcattgcatttgtaactaaagagatcacacacaactgtgccatctggtcacaaaacagaagataaggacaagtttctttttataaaagtattccagctaataaatgatgaaggaatgacagactctcttattaaattactggacctaggtgttgaccatcaataacagagacacatcaatcacaagagacaacctgaaacatcatgtgcctcttaatggaagaacacaacaccaactattgaactatctttcaaaaaaaaaaatcaaacttgaatctgattgagcttctaaacaccacagagaagttagaggaacatgtttgtttgttttttgagacggagtctcgctctgtggcccaggctggaatgcagtggggccatcttggctcaccacaatctccgcctcctggattcaagcaattctctggcctcagcctcccaagtagctgggattacaggtgtgcaccatcacgcccagctaatttttatatttttagtagagatggggtttcactgtgttggccgggctggtctcaaactcccgacctcaggtgatctgcccaccttggcttcccaaagtgctgggattacaggcatgagccactacgccccgcctagaggaacatgttaaccaccacaatggtgagccaatcagcaaaatcaaactctggaaaacaccattaagacaaactacctggttttatcaaacaaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaagtttggaatgcaatgggcacgatcactgctcactgcagccttgacctcctgggctcaaataatcctcccattctcagcctaccaagtagctaggactacaggcatatgccaccatgccttgctaactttgtttatgttttgtagagaagtggtcgaagtggtctcactatgctgccaggctggtctcaaactcctaaactcaagtgatccttctgcctcagcctcccaaagtgctgggattacaagtgtgagctattgcacccagcctggcaaataactttaaaacatgacaccagaaaaagcacaaacaataaattgggactgtatcaaagtttaaaacgtttgctcttcaggccaggtgccaccccccagctcacgcctataatcttagcactttgggaggctgaggcgggtggatcacctcaggtcaggagttcgagaccagcctggccaacatggtgaaaccccgtctctactaaaaatacaaaaattagccaggacagtggtatgtgcctgtagtcccagttacttaggaggctgaggcagaagaatcacttgaacccgggaggcggaggttgcagtgagccaagatcacaccactacactctagcctgggcaacagggtgagactccatctcaaaaaaaaacaaaacttttgctcttcaaagacacaatgaagaaaaaagacaagccagaggcttaaaaagaaatttttttgcaaaacatatacctaatatggatttatatcaaaaagctcttaaaaataaacaatcctttttttttttttttttttttttgagacagggtctccctctggtcactgggctgcagtgcagtagcaccatcttggctcactgcagcctcaacctcctgggttcaagtgatcctcctgcctcagacctgccaagtagctgggactacaggcgcacgccaccacacccagctaatttttgtatttttttagtagagacagagtttcacctattacccaggctggtctcgagttcctgagctcaagcgatctgcccacctcagcctcccaaatgctaggattataggcatgaggcaccacacccggacaataatccaatttttcaatcaaaagatttgaataggtacttcagcaaagaaaatatatgaatggcaagcacatgaaaagataattagtcactagggaaatacaaattaaaaccactatgaagtatcattacacaccaactaaaatggctaaaatacgaacaataggaaatttaataaggatggagaagtgagtcctcatacaatgctggtgcaaatgtaaaaatggtacagccactttgaaaatggtttggcaatttcttaaaaagctaaacacaggccgggcacggtggctcacgcctgtaatcccagcactttgggaggcagagatgggcagatcatgaggtcaggagattgagaccatcctggctaaaacggtgaaaccccatctctactaaaaatacaaaaaattagccgggcgtagtggcggtcgcctgcagtcccagctactccggaggctgaggcagaagaatagcttgaacctgggaggcggagcctgcagtgagccgagatcgcaccactgcactccagcctgggcgactgagcgagactcagtctcaaaaaaaaacaaaaacaaaaacaaaaaaaaagctaaacatagacttatcatacaaccaagcaattccactcttgaggatcaccaaaaagaaatgaaaacagccacacaaagactttacttgtgttcactgccaagaactagaaataacccaaatgtccatcaactagtgaatggataaacaaaacgttttacctatttatacaatggaattattctcccagcactttgggaggccgaggggggcggatcacgaggtcaggagatcggtaccatcctggctaacactgtgaaacccgtctctactaaaaacacaaaaaattagtctgatgtggtggcaggcacctgtagtcccagctactcgggaggctgaggcaggagaatggcgtgaacccagaaggcggagcttgtagtgagccgagatcatgccactgcactccagcctgggtgacagagcgagagtccatctcaaaaaaaaaaagaaaaggaattattctcagcaataaaaacaaactactgatacatgcaataacaaggataaatctcaaaaacttcatgctatatgaaacatgccagacacaaaagactacatattggatgattctatttatgtgaaatttctagaaaaggcaaaattgtatagaaaatacatcagtggtttcccagaatcaggatgcattgtctgtaaatgaccacattttgggggtaataaaatgttctaaaactaaatggtgatgatggttgcataactctatacaattactaaaattcatcaagtaggtcacttacaatataaaacatgcttcaataaaacattgtttaaaaaaagagagaagataacacaacgtgttggtcaattggatcctttaaacaatattttttaaatttatttttgttattgtaaaatacacataaaatttaccattctaatcaccttagatgtatagttctgtggcattaaggacattcacaatgttgtacaagaaaattttttaaattacagcatgtataacaatgggaactgagctctgcataaattctagtgttcataagaaaaaatgtagatcaggtcgggcacggtggctcacgcctgtaatcccagcactttgggaggccaagacgggcagatcacgaggccaacacggagaaaccccgtctctactaaaaatacaaaaaatttgccgggcgtggtggcgggcgcctgtagtcccagctactccggaggctgaggcaggagaatggcatgaacccaggaggtgaagcttgcggtgagccgagatcgcgccactgcactctagcctgggtgacagagagagactccgtctcaaaaaaaagaaaagaaaagaaaaaatgtagatcaataatattattttgctgacgcattggagaaagtaaaggctgggtgcagcttcaagctgaggaccacccaccatgcccccatcatggtggttcccctaggtgctgaagggcccagccatagctctcgccctcgcagggtccctccagggtctctgctgtttcctacctaggggtgactgcagccatggctaagaaagcgccagcgcccacccacctgggccaatggactggttctgctcgtgccacgctggttctgctcctcgccatctcggcagttcagaaagaaccccaacgagcttgtgatctcccgggtcctgtgggcgtatcaacagggggccagccctgtccctcaaccctggggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccctaaccactgctgtggatgtcactggccaaaggtcatgaggggagtgggccacatgagtggccacttgccatgactccctgagcagggtgagcccccactcatcctgtgccatgttatgtttccacccaagcagcagggtaggaggcacaatgagtgcccattcctctccctgatgggccccccaagctctacagaccaagcaaggagaccccatgacccatggcatgaaatcatcttgaagtttttgctttttttttggagacagagtatcgctctgtcgcccaggctggaatgcagtggcacaatctcggctcactgcaacctctgcctcccgggttcaagcaattctcctgcctcagcctcatgagtagttgggactacaggcatgtgccaccacatcagcccggctaattttttgtatttttagtagagacagggtttcaccgtgttagccaggatggtcttgatttcctgacctcgtgatccgcccaccccggcctcccaaagtgctgggattacaggcgtgagccaccgcacccagcctactcttacatttttttaggtttttatttactcactgctttaagcatacacgacacttcggttttattcctccctttgtaatgttttttctcttaagccacttttttttttttttgcaatgccttcctctttgaaagcattaaaaaaacagtattttgtttatgtttcaacaacaacaaagaggacttaatgtctggcacactaaaatatttaccaataaaacaaactgatatttggaatttttttaagttttaaaagtgtggtcactgtattgtgatcacacaattacattaggaaaatgtcttattcttagagatgtacattaaagtattaagagtactgagttataatgtctgcaatagagcctcaaatgtttcacaggggactatataaatacatatatatgcctatatatacatatattacatatatacacatatataaaagacaaagagagaaagcaaacagtgattctaggtgaaagacaaagtgagaactcagcaaaaacgtaaattagtacaggtttgttggaaagcaatgtgatgacatctcaaaattggaagaaatttacaaaaactaaaacatgcctaatgcatgtcctttgacccaacaccccttctaggaatttatctttaaaaaactcacacaagaccacaaagcaagaaagggtattaattacaaaaattttttaatggtttaatactcaaatatctaccaataggtggttaggtaaataagttattgcaaatgcttaaaatgaaaaaaaatatatgaaaagaagaaaggggtgtgggtacagatgaaaccgcattggctgtgagtttattacagaagcaatctttgaataatggatatttggatgttcatctcactgtttagtctacttttatatatgtttgacattctccctaacaagtcaaaaacaaaaaagaaccacacaaaattccaagggcacaattctttacaagtggtcatcgaccccctttctttcccaaattaataatatcaacatgggagggaaggttctacactacataaacaagtacacataaatattaaagttctttcagcctgggcaacatagtgagaccctgtctcttaaaaaaagattttcttttagttagctaggtgtggtgattcacatctgcagtcctagctactagagagactgagacagaaggactgcttgagctcaggagttcaaggctgcagtgagccatgatcgtgtgtcactttagcttgcatgacagagtgagactccaactcttcaaaaaagaaaaagttccatcactcttaattattcttacatcctcaggtcatccctgaacagaagagttttgctttcaagcatcttggatccagtagtaagtagatggcagctcacatttactgtgctcccaccagcaagcagctcttcatttctaatagctctagctaaggaaagaaacaagtgtagaaaaagccaggcacagtggccgcgcctgtaaattttagcactttagaaggccaaacaaagcaggaggaccacttgagcccaggagtttgagaccagcctggacaacatagggaaatgggagatcctatctctaccaaaaaaaaaaaaaattgtaaaaaatttgccaggcatggtggctcatgactgtggtcccaactacctgggaggctgaggctggaggatatgtaggcccaggaggtcaaggctgcagtgagcactgatcctgccaccgcattccggcctgggcaacagagcaagacccagtctctcacacacacacacacacacacacacacacacacacacacacacacacataaatgaaagattactgcctgttttgaactttgttttctatggagttgttcagcttttcctattagaagttcaaatatgtgtactacatattgtgccatttctgaattataacaaaagcaagagagcttagaaatcatccagcccagttggccgcagtggctcacgcctgtaatcccagcactttgggaggccgaggcaggtggatcacggggttaggagatcgagaccatcctggctaacacggcgaaacctgtctctactaaaaatacaaaaaattagccgggcgtggtggcgggcacctgtagtcccagctacttgggaggctgaggcaggagaatggcgtgaacccgggaggcgaagcttgcagtgagccaagatcgcaccactgcactccagcctgggtgacagagcgagactccgtctcaataaaaaaaaaaaaaaaaaaagaaatcacccagcccagtatcttgaattaacaaataagcaaaactatccaggcccaaagttattatttcaaattataataacttcagtattctctagttaggaggtattctcctcagtttaatttgaataaactaagtgctcactgaacacctgccacagtgaactgtaatgaataacgagcaaaagttggaagtctgtcttgagggtgctaaactcacagtccaaggccactgactaccatccaaaaccctacagtcattgggctcaagagcccacaaactcaacacctgctcagcaccagcctgcttaaacttgaagcaggaattttcaaaacagcctcctctttctttcagcaagtcatatgatattcattaactttcaaagcaatgagaaaatataatgtaagtt

SEQ ID NO: 240 - DNA, 12285 bp, Homo sapiens
ccagaatactacttttctcggaatctttaacaaaacgtcaaacaaattcagactgttggactgttaaacttcaaagagccaccttaatattttgaaaacatcaagaaaaagttgagcaagaaagagaggaaagggagggagagaagaaggaaagaaggatggatggaaagaaggaaggaaggaaaagttttctcaactttaacaaatactattatcaaagctaaggagttttggccttgggaattcagatattacgcataaaacaaggaaataaacctaatgaacaaacattactactatggggtgatgtcaaccttgcaattttggagagagattaatgaagtggggtgaagtataaagagaataattttttcacttcaaatgatgagtaatgaagttcaacatataaacattttttgtttgctcattttttcccaaataactactttacacccacattactgtctcatttgcaaacgtctgcatagtatcttcagcaactatacctagcactgcatttttacatacattaagccagctgcctggatgattttttaaaattgctctttgtttcactgaataactgaggctggtgactctaaaagttagagaaaactttaataagtaacacccagtccaacagtcctcaacagttctgttgtacacaccattcccatgtgccaacatttcctcaaataacagctctccattaccctacagtgcttttctagagaattcttccctacctgctgtggtttgaatgttgtgtcccacccaaaattcacatgctgaaacttctttttttttttttttttttgagatggagttttgctcttattgcataggctgcagtgcagtggcacaatctcagctcactgcaacctccacctcttgggttcaagcaattatcgtgcctcagcctcccgagtagctggggctacagggaggcgccaccatgcctggctaatttttgtatctttagtagagacgggtttcaccatgttggccaggatggtctcgaactactgacctcaggtgatccgcccacctcggcctcccaaagtgctgtgattacaggcgtgagccacctcgcccagcctgcacgttgaaagttaatccctaatatgagagtattaagacgtgtggcctttcaggaagcgattggatcaatgccattataagaagcttctgagagctgcctgccccttcttgctttcacattcccttccaccttctaccacatgaggatgcaccatcaatgaggaatggcacctccccagacactaaatctgccagcaccttgattttggacttctcagactccagaatagtgagaaaataagtttctattattcataagttactgagtctcaggtgttctgtcatagcagcacaaatgactaaaacatcatccatccccgaggaggagattgtccatttctgtgttccaacaccatcaatgacacagggataaaaaactcccacgactaccttctaggataatctattccacttctaagcagctccgccacaaagcctgtccttaacctgctgcaaagtccctatggcttctgcccattgctgttgcccactcagaatgagtctgtgttcattcactcacacagagcccttcacatagctgagagaactaacgttcatcaactgttcttcctaagcaggtcctgagctgcctcaccttcctagtccctcctctaaaatacattccagtttatctgtagcccaaaacagaatacaaaagaataaagtattgtttataatacaaagggtaagtgtttgaggatggacacctctattttacattacgtgattattacacattctatgtctgtatcaaaacatctcacataccccataaatacatacacctctatgtagccacaaaaattaaaataaaaaaaatttttttaataataaattaaaatgttaaagtgattttgatttctgctttatatcgtgtatttctgtgactaggccaaacaggtcatgggtaaatctgctcagttaattagactttgatattgagctcttggtaatcagtcttaatggaacaaaaactactccttcctcagtatgtttccttaaactaaccaataatttcataaaagcagatcatctttcagaaggaaaaactaagggaaatcataggtgggttagcacactccacaatgtaaaggaaacaataaatatacattcccatgcaaaattcaattctctctcttcaaaactaccacagcattttgtgggaccctctagaagagcatttcacctggagtgattcaggcctacctgctcctcagggtctgggccccaccttcatctttctctatgattttacactgtgcctgacagtggtgagcttgcaacttctgtctgaatgaaactgatcaggagtagttctggcagctatttagatagaattggagtctcagcactcattatttatcatactcatcctttaatttaaaagagggccaagaaaaccaaattatttaaagatttcccaatttctgaaaatataatgctgtatcagttgttttttttttaagcagctcaaaaaatagcacatagagcaggtaaaaagggtaggaaaaatttttttctatgcaaaagccttaacatttataaacttcaaccaaatccctataaaaaacatgtagtttttgcactgtgtagtccatatgctaaatggacatgtttagttacatgttttcttgagcagtactttttatttgtagcaaagctattacatcttatacattatattacacgtaaaagtccattttaaaccaaattacttcaaaatttgacctatattacatctggcacagactagctgttctgctatactgtttaaatgcctgctatattcgcagcagttactttataaaacacataatctttatgtgctagcagtaaatttctatacctttaagggataattctaggctaatcaattagtataccaaccttccctatccccgaccccattcattcacttggccctgaccatgctaagcatctgctacatataactcctagtaggaggtacaactatgtagaaacactacaaagttactgtgacagtatttaaaacagatgcactgacagccaaaaaaaaggggaaaaaaatcccatacaaaaattgtgaaaagagttaagatacaaaagaaaaaaataacagtaaaatagcaagcgctcaatataatttatgtcaattttgtaacttttcttatttatacacaagatcaaggaaagaacagaaaatccttttataacaataaaacagtgtaagagacagaagcatcgtaagtcaaagctaaaaaaaagcaaccaattattatatactcattacaaaataatacactgggaaaaggtcgaaactgtaattggctcttataaagtagtaattcaggatatatacagtctatgactgtaaagcacatctttataatacaagtagaacactttcatacagtttccaacagaagggtttattcataagccattactgcagaggaaaacaacaacagacaaatcctcaacctgttaataagttcaaactgtttgccaattcaactgggaaataatgcattagaaaaaatacctacttgttaacaaagtcattgcatttgtaactaaagagatcacacacaactgtgccatctggtcacaaaacagaagataaggacaagtttctttttataaaagtattccagctaataaatgatgaaggaatgacagactctcttattaaattactggacctaggtgttgaccatcaataacagagacacatcaatcacaagagacaacctgaaacatcatgtgcctcttaatggaagaacacaacaccaactattgaactatctttcaaaaaaaaaaatcaaacttgaatctgattgagcttctaaacaccacagagaagttagaggaacatgtttgtttgttttttgagacggagtctcgctctgtggcccaggctggaatgcagtggggccatcttggctcaccacaatctccgcctcctggattcaagcaattctctggcctcagcctcccaagtagctgggattacaggtgtgcaccatcacgcccagctaatttttatatttttagtagagatggggtttcactgtgttggccgggctggtctcaaactcccgacctcaggtgatctgcccaccttggcttcccaaagtgctgggattacaggcatgagccactacgccccgcctagaggaacatgttaaccaccacaatggtgagccaatcagcaaaatcaaactctggaaaacaccattaagacaaactacctggttttatcaaacaaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaagtttggaatgcaatgggcacgatcactgctcactgcagccttgacctcctgggctcaaataatcctcccattctcagcctaccaagtagctaggactacaggcatatgccaccatgccttgctaactttgtttatgttttgtagagaagtggtcgaagtggtctcactatgctgccaggctggtctcaaactcctaaactcaagtgatccttctgcctcagcctcccaaagtgctgggattacaagtgtgagctattgcacccagcctggcaaataactttaaaacatgacaccagaaaaagcacaaacaataaattgggactgtatcaaagtttaaaacgtttgctcttcaggccaggtgccaccccccagctcacgcctataatcttagcactttgggaggctgaggcgggtggatcacctcaggtcaggagttcgagaccagcctggccaacatggtgaaaccccgtctctactaaaaatacaaaaattagccaggacagtggtatgtgcctgtagtcccagttacttaggaggctgaggcagaagaatcacttgaacccgggaggcggaggttgcagtgagccaagatcacaccactacactctagcctgggcaacagggtgagactccatctcaaaaaaaaacaaaacttttgctcttcaaagacacaatgaagaaaaaagacaagccagaggcttaaaaagaaatttttttgcaaaacatatacctaatatggatttatatcaaaaagctcttaaaaataaacaatcctttttttttttttttttttttttgagacagggtctccctctggtcactgggctgcagtgcagtagcaccatcttggctcactgcagcctcaacctcctgggttcaagtgatcctcctgcctcagacctgccaagtagctgggactacaggcgcacgccaccacacccagctaatttttgtatttttttagtagagacagagtttcacctattacccaggctggtctcgagttcctgagctcaagcgatctgcccacctcagcctcccaaatgctaggattataggcatgaggcaccacacccggacaataatccaatttttcaatcaaaagatttgaataggtacttcagcaaagaaaatatatgaatggcaagcacatgaaaagataattagtcactagggaaatacaaattaaaaccactatgaagtatcattacacaccaactaaaatggctaaaatacgaacaataggaaatttaataaggatggagaagtgagtcctcatacaatgctggtgcaaatgtaaaaatggtacagccactttgaaaatggtttggcaatttcttaaaaagctaaacacaggccgggcacggtggctcacgcctgtaatcccagcactttgggaggcagagatgggcagatcatgaggtcaggagattgagaccatcctggctaaaacggtgaaaccccatctctactaaaaatacaaaaaattagccgggcgtagtggcggtcgcctgcagtcccagctactccggaggctgaggcagaagaatagcttgaacctgggaggcggagcctgcagtgagccgagatcgcaccactgcactccagcctgggcgactgagcgagactcagtctcaaaaaaaaacaaaaacaaaaacaaaaaaaaagctaaacatagacttatcatacaaccaagcaattccactcttgaggatcaccaaaaagaaatgaaaacagccacacaaagactttacttgtgttcactgccaagaactagaaataacccaaatgtccatcaactagtgaatggataaacaaaacgttttacctatttatacaatggaattattctcccagcactttgggaggccgaggggggcggatcacgaggtcaggagatcggtaccatcctggctaacactgtgaaacccgtctctactaaaaacacaaaaaattagtctgatgtggtggcaggcacctgtagtcccagctactcgggaggctgaggcaggagaatggcgtgaacccagaaggcggagcttgtagtgagccgagatcatgccactgcactccagcctgggtgacagagcgagagtccatctcaaaaaaaaaaagaaaaggaattattctcagcaataaaaacaaactactgatacatgcaataacaaggataaatctcaaaaacttcatgctatatgaaacatgccagacacaaaagactacatattggatgattctatttatgtgaaatttctagaaaaggcaaaattgtatagaaaatacatcagtggtttcccagaatcaggatgcattgtctgtaaatgaccacattttgggggtaataaaatgttctaaaactaaatggtgatgatggttgcataactctatacaattactaaaattcatcaagtaggtcacttacaatataaaacatgcttcaataaaacattgtttaaaaaaagagagaagataacacaacgtgttggtcaattggatcctttaaacaatattttttaaatttatttttgttattgtaaaatacacataaaatttaccattctaatcaccttagatgtatagttctgtggcattaaggacattcacaatgttgtacaagaaaattttttaaattacagcatgtataacaatgggaactgagctctgcataaattctagtgttcataagaaaaaatgtagatcaggtcgggcacggtggctcacgcctgtaatcccagcactttgggaggccaagacgggcagatcacgaggccaacacggagaaaccccgtctctactaaaaatacaaaaaatttgccgggcgtggtggcgggcgcctgtagtcccagctactccggaggctgaggcaggagaatggcatgaacccaggaggtgaagcttgcggtgagccgagatcgcgccactgcactctagcctgggtgacagagagagactccgtctcaaaaaaaagaaaagaaaagaaaaaatgtagatcaataatattattttgctgacgcattggagaaagtaaaggctgggtgcagcttcaagctgaggaccacccaccatgcccccatcatggtggttcccctaggtgctgaagggcccagccatagctctcgccctcgcagggtccctccagggtctctgctgtttcctacctaggggtgactgcagccatggctaagaaagcgccagcgcccacccacctgggccaatggactggttctgctcgtgccacgctggttctgctcctcgccatctcggcagttcagaaagaaccccaacgagcttgtgatctcccgggtcctgtgggcgtatcaacagggggccagccctgtccctcaaccctggggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccctaaccactgctgtggatgtcactggccaaaggtcatgaggggagtgggccacatgagtggccacttgccatgactccctgagcagggtgagcccccactcatcctgtgccatgttatgtttccacccaagcagcagggtaggaggcacaatgagtgcccattcctctccctgatgggccccccaagctctacagaccaagcaaggagaccccatgacccatggcatgaaatcatcttgaagtttttgctttttttttggagacagagtatcgctctgtcgcccaggctggaatgcagtggcacaatctcggctcactgcaacctctgcctcccgggttcaagcaattctcctgcctcagcctcatgagtagttgggactacaggcatgtgccaccacatcagcccggctaattttttgtatttttagtagagacagggtttcaccgtgttagccaggatggtcttgatttcctgacctcgtgatccgcccaccccggcctcccaaagtgctgggattacaggcgtgagccaccgcacccagcctactcttacatttttttaggtttttatttactcactgctttaagcatacacgacacttcggttttattcctccctttgtaatgttttttctcttaagccacttttttttttttttgcaatgccttcctctttgaaagcattaaaaaaacagtattttgtttatgtttcaacaacaacaaagaggacttaatgtctggcacactaaaatatttaccaataaaacaaactgatatttggaatttttttaagttttaaaagtgtggtcactgtattgtgatcacacaattacattaggaaaatgtcttattcttagagatgtacattaaagtattaagagtactgagttataatgtctgcaatagagcctcaaatgtttcacaggggactatataaatacatatatatgcctatatatacatatattacatatatacacatatataaaagacaaagagagaaagcaaacagtgattctaggtgaaagacaaagtgagaactcagcaaaaacgtaaattagtacaggtttgttggaaagcaatgtgatgacatctcaaaattggaagaaatttacaaaaactaaaacatgcctaatgcatgtcctttgacccaacaccccttctaggaatttatctttaaaaaactcacacaagaccacaaagcaagaaagggtattaattacaaaaattttttaatggtttaatactcaaatatctaccaataggtggttaggtaaataagttattgcaaatgcttaaaatgaaaaaaaatatatgaaaagaagaaaggggtgtgggtacagatgaaaccgcattggctgtgagtttattacagaagcaatctttgaataatggatatttggatgttcatctcactgtttagtctacttttatatatgtttgacattctccctaacaagtcaaaaacaaaaaagaaccacacaaaattccaagggcacaattctttacaagtggtcatcgaccccctttctttcccaaattaataatatcaacatgggagggaaggttctacactacataaacaagtacacataaatattaaagttctttcagcctgggcaacatagtgagaccctgtctcttaaaaaaagattttcttttagttagctaggtgtggtgattcacatctgcagtcctagctactagagagactgagacagaaggactgcttgagctcaggagttcaaggctgcagtgagccatgatcgtgtgtcactttagcttgcatgacagagtgagactccaactcttcaaaaaagaaaaagttccatcactcttaattattcttacatcctcaggtcatccctgaacagaagagttttgctttcaagcatcttggatccagtagtaagtagatggcagctcacatttactgtgctcccaccagcaagcagctcttcatttctaatagctctagctaaggaaagaaacaagtgtagaaaaagccaggcacagtggccgcgcctgtaaattttagcactttagaaggccaaacaaagcaggaggaccacttgagcccaggagtttgagaccagcctggacaacatagggaaatgggagatcctatctctaccaaaaaaaaaaaaaattgtaaaaaatttgccaggcatggtggctcatgactgtggtcccaactacctgggaggctgaggctggaggatatgtaggcccaggaggtcaaggctgcagtgagcactgatcctgccaccgcattccggcctgggcaacagagcaagacccagtctctcacacacacacacacacacacacacacacacacacacacacacacacataaatgaaagattactgcctgttttgaactttgttttctatggagttgttcagcttttcctattagaagttcaaatatgtgtactacatattgtgccatttctgaattataacaaaagcaagagagcttagaaatcatccagcccagttggccgcagtggctcacgcctgtaatcccagcactttgggaggccgaggcaggtggatcacggggttaggagatcgagaccatcctggctaacacggcgaaacctgtctctactaaaaatacaaaaaattagccgggcgtggtggcgggcacctgtagtcccagctacttgggaggctgaggcaggagaatggcgtgaacccgggaggcgaagcttgcagtgagccaagatcgcaccactgcactccagcctgggtgacagagcgagactccgtctcaataaaaaaaaaaaaaaaaaaagaaatcacccagcccagtatcttgaattaacaaataagcaaaactatccaggcccaaagttattatttcaaattataataacttcagtattctctagttaggaggtattctcctcagtttaatttgaataaactaagtgctcactgaacacctgccacagtgaactgtaatgaataacgagcaaaagttggaagtctgtcttgagggtgctaaactcacagtccaaggccactgactaccatccaaaaccctacagtcattgggctcaagagcccacaaactcaacacctgctcagcaccagcctgcttaaacttgaagcaggaattttcaaaacagcctcctctttctttcagcaagtcatatgatattcattaactttcaaagcaatgagaaaatataatgtaagtt

SEQ ID NO: 241 - DNA, 18432 bp, Homo sapiens
actccttcctcagtatgtttccttaaactaaccaataatttcataaaagcagatcatctttcagaaggaaaaactaagggaaatcataggtgggttagcacactccacaatgtaaaggaaacaataaatatacattcccatgcaaaattcaattctctctcttcaaaactaccacagcattttgtgggaccctctagaagagcatttcacctggagtgattcaggcctacctgctcctcagggtctgggccccaccttcatctttctctatgattttacactgtgcctgacagtggtgagcttgcaacttctgtctgaatgaaactgatcaggagtagttctggcagctatttagatagaattggagtctcagcactcattatttatcatactcatcctttaatttaaaagagggccaagaaaaccaaattatttaaagatttcccaatttctgaaaatataatgctgtatcagttgttttttttttaagcagctcaaaaaatagcacatagagcaggtaaaaagggtaggaaaaatttttttctatgcaaaagccttaacatttataaacttcaaccaaatccctataaaaaacatgtagtttttgcactgtgtagtccatatgctaaatggacatgtttagttacatgttttcttgagcagtactttttatttgtagcaaagctattacatcttatacattatattacacgtaaaagtccattttaaaccaaattacttcaaaatttgacctatattacatctggcacagactagctgttctgctatactgtttaaatgcctgctatattcgcagcagttactttataaaacacataatctttatgtgctagcagtaaatttctatacctttaagggataattctaggctaatcaattagtataccaaccttccctatccccgaccccattcattcacttggccctgaccatgctaagcatctgctacatataactcctagtaggaggtacaactatgtagaaacactacaaagttactgtgacagtatttaaaacagatgcactgacagccaaaaaaaaggggaaaaaaatcccatacaaaaattgtgaaaagagttaagatacaaaagaaaaaaataacagtaaaatagcaagcgctcaatataatttatgtcaattttgtaacttttcttatttatacacaagatcaaggaaagaacagaaaatccttttataacaataaaacagtgtaagagacagaagcatcgtaagtcaaagctaaaaaaaagcaaccaattattatatactcattacaaaataatacactgggaaaaggtcgaaactgtaattggctcttataaagtagtaattcaggatatatacagtctatgactgtaaagcacatctttataatacaagtagaacactttcatacagtttccaacagaagggtttattcataagccattactgcagaggaaaacaacaacagacaaatcctcaacctgttaataagttcaaactgtttgccaattcaactgggaaataatgcattagaaaaaatacctacttgttaacaaagtcattgcatttgtaactaaagagatcacacacaactgtgccatctggtcacaaaacagaagataaggacaagtttctttttataaaagtattccagctaataaatgatgaaggaatgacagactctcttattaaattactggacctaggtgttgaccatcaataacagagacacatcaatcacaagagacaacctgaaacatcatgtgcctcttaatggaagaacacaacaccaactattgaactatctttcaaaaaaaaaaatcaaacttgaatctgattgagcttctaaacaccacagagaagttagaggaacatgtttgtttgttttttgagacggagtctcgctctgtggcccaggctggaatgcagtggggccatcttggctcaccacaatctccgcctcctggattcaagcaattctctggcctcagcctcccaagtagctgggattacaggtgtgcaccatcacgcccagctaatttttatatttttagtagagatggggtttcactgtgttggccgggctggtctcaaactcccgacctcaggtgatctgcccaccttggcttcccaaagtgctgggattacaggcatgagccactacgccccgcctagaggaacatgttaaccaccacaatggtgagccaatcagcaaaatcaaactctggaaaacaccattaagacaaactacctggttttatcaaacaaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaagtttggaatgcaatgggcacgatcactgctcactgcagccttgacctcctgggctcaaataatcctcccattctcagcctaccaagtagctaggactacaggcatatgccaccatgccttgctaactttgtttatgttttgtagagaagtggtcgaagtggtctcactatgctgccaggctggtctcaaactcctaaactcaagtgatccttctgcctcagcctcccaaagtgctgggattacaagtgtgagctattgcacccagcctggcaaataactttaaaacatgacaccagaaaaagcacaaacaataaattgggactgtatcaaagtttaaaacgtttgctcttcaggccaggtgccaccccccagctcacgcctataatcttagcactttgggaggctgaggcgggtggatcacctcaggtcaggagttcgagaccagcctggccaacatggtgaaaccccgtctctactaaaaatacaaaaattagccaggacagtggtatgtgcctgtagtcccagttacttaggaggctgaggcagaagaatcacttgaacccgggaggcggaggttgcagtgagccaagatcacaccactacactctagcctgggcaacagggtgagactccatctcaaaaaaaaacaaaacttttgctcttcaaagacacaatgaagaaaaaagacaagccagaggcttaaaaagaaatttttttgcaaaacatatacctaatatggatttatatcaaaaagctcttaaaaataaacaatcctttttttttttttttttttttttgagacagggtctccctctggtcactgggctgcagtgcagtagcaccatcttggctcactgcagcctcaacctcctgggttcaagtgatcctcctgcctcagacctgccaagtagctgggactacaggcgcacgccaccacacccagctaatttttgtatttttttagtagagacagagtttcacctattacccaggctggtctcgagttcctgagctcaagcgatctgcccacctcagcctcccaaatgctaggattataggcatgaggcaccacacccggacaataatccaatttttcaatcaaaagatttgaataggtacttcagcaaagaaaatatatgaatggcaagcacatgaaaagataattagtcactagggaaatacaaattaaaaccactatgaagtatcattacacaccaactaaaatggctaaaatacgaacaataggaaatttaataaggatggagaagtgagtcctcatacaatgctggtgcaaatgtaaaaatggtacagccactttgaaaatggtttggcaatttcttaaaaagctaaacacaggccgggcacggtggctcacgcctgtaatcccagcactttgggaggcagagatgggcagatcatgaggtcaggagattgagaccatcctggctaaaacggtgaaaccccatctctactaaaaatacaaaaaattagccgggcgtagtggcggtcgcctgcagtcccagctactccggaggctgaggcagaagaatagcttgaacctgggaggcggagcctgcagtgagccgagatcgcaccactgcactccagcctgggcgactgagcgagactcagtctcaaaaaaaaacaaaaacaaaaacaaaaaaaaagctaaacatagacttatcatacaaccaagcaattccactcttgaggatcaccaaaaagaaatgaaaacagccacacaaagactttacttgtgttcactgccaagaactagaaataacccaaatgtccatcaactagtgaatggataaacaaaacgttttacctatttatacaatggaattattctcccagcactttgggaggccgaggggggcggatcacgaggtcaggagatcggtaccatcctggctaacactgtgaaacccgtctctactaaaaacacaaaaaattagtctgatgtggtggcaggcacctgtagtcccagctactcgggaggctgaggcaggagaatggcgtgaacccagaaggcggagcttgtagtgagccgagatcatgccactgcactccagcctgggtgacagagcgagagtccatctcaaaaaaaaaaagaaaaggaattattctcagcaataaaaacaaactactgatacatgcaataacaaggataaatctcaaaaacttcatgctatatgaaacatgccagacacaaaagactacatattggatgattctatttatgtgaaatttctagaaaaggcaaaattgtatagaaaatacatcagtggtttcccagaatcaggatgcattgtctgtaaatgaccacattttgggggtaataaaatgttctaaaactaaatggtgatgatggttgcataactctatacaattactaaaattcatcaagtaggtcacttacaatataaaacatgcttcaataaaacattgtttaaaaaaagagagaagataacacaacgtgttggtcaattggatcctttaaacaatattttttaaatttatttttgttattgtaaaatacacataaaatttaccattctaatcaccttagatgtatagttctgtggcattaaggacattcacaatgttgtacaagaaaattttttaaattacagcatgtataacaatgggaactgagctctgcataaattctagtgttcataagaaaaaatgtagatcaggtcgggcacggtggctcacgcctgtaatcccagcactttgggaggccaagacgggcagatcacgaggccaacacggagaaaccccgtctctactaaaaatacaaaaaatttgccgggcgtggtggcgggcgcctgtagtcccagctactccggaggctgaggcaggagaatggcatgaacccaggaggtgaagcttgcggtgagccgagatcgcgccactgcactctagcctgggtgacagagagagactccgtctcaaaaaaaagaaaagaaaagaaaaaatgtagatcaataatattattttgctgacgcattggagaaagtaaaggctgggtgcagcttcaagctgaggaccacccaccatgcccccatcatggtggttcccctaggtgctgaagggcccagccatagctctcgccctcgcagggtccctccagggtctctgctgtttcctacctaggggtgactgcagccatggctaagaaagcgccagcgcccacccacctgggccaatggactggttctgctcgtgccacgctggttctgctcctcgccatctcggcagttcagaaagaaccccaacgagcttgtgatctcccgggtcctgtgggcgtatcaacagggggccagccctgtccctcaaccctggggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccctaaccactgctgtggatgtcactggccaaaggtcatgaggggagtgggccacatgagtggccacttgccatgactccctgagcagggtgagcccccactcatcctgtgccatgttatgtttccacccaagcagcagggtaggaggcacaatgagtgcccattcctctccctgatgggccccccaagctctacagaccaagcaaggagaccccatgacccatggcatgaaatcatcttgaagtttttgctttttttttggagacagagtatcgctctgtcgcccaggctggaatgcagtggcacaatctcggctcactgcaacctctgcctcccgggttcaagcaattctcctgcctcagcctcatgagtagttgggactacaggcatgtgccaccacatcagcccggctaattttttgtatttttagtagagacagggtttcaccgtgttagccaggatggtcttgatttcctgacctcgtgatccgcccaccccggcctcccaaagtgctgggattacaggcgtgagccaccgcacccagcctactcttacatttttttaggtttttatttactcactgctttaagcatacacgacacttcggttttattcctccctttgtaatgttttttctcttaagccacttttttttttttttgcaatgccttcctctttgaaagcattaaaaaaacagtattttgtttatgtttcaacaacaacaaagaggacttaatgtctggcacactaaaatatttaccaataaaacaaactgatatttggaatttttttaagttttaaaagtgtggtcactgtattgtgatcacacaattacattaggaaaatgtcttattcttagagatgtacattaaagtattaagagtactgagttataatgtctgcaatagagcctcaaatgtttcacaggggactatataaatacatatatatgcctatatatacatatattacatatatacacatatataaaagacaaagagagaaagcaaacagtgattctaggtgaaagacaaagtgagaactcagcaaaaacgtaaattagtacaggtttgttggaaagcaatgtgatgacatctcaaaattggaagaaatttacaaaaactaaaacatgcctaatgcatgtcctttgacccaacaccccttctaggaatttatctttaaaaaactcacacaagaccacaaagcaagaaagggtattaattacaaaaattttttaatggtttaatactcaaatatctaccaataggtggttaggtaaataagttattgcaaatgcttaaaatgaaaaaaaatatatgaaaagaagaaaggggtgtgggtacagatgaaaccgcattggctgtgagtttattacagaagcaatctttgaataatggatatttggatgttcatctcactgtttagtctacttttatatatgtttgacattctccctaacaagtcaaaaacaaaaaagaaccacacaaaattccaagggcacaattctttacaagtggtcatcgaccccctttctttcccaaattaataatatcaacatgggagggaaggttctacactacataaacaagtacacataaatattaaagttctttcagcctgggcaacatagtgagaccctgtctcttaaaaaaagattttcttttagttagctaggtgtggtgattcacatctgcagtcctagctactagagagactgagacagaaggactgcttgagctcaggagttcaaggctgcagtgagccatgatcgtgtgtcactttagcttgcatgacagagtgagactccaactcttcaaaaaagaaaaagttccatcactcttaattattcttacatcctcaggtcatccctgaacagaagagttttgctttcaagcatcttggatccagtagtaagtagatggcagctcacatttactgtgctcccaccagcaagcagctcttcatttctaatagctctagctaaggaaagaaacaagtgtagaaaaagccaggcacagtggccgcgcctgtaaattttagcactttagaaggccaaacaaagcaggaggaccacttgagcccaggagtttgagaccagcctggacaacatagggaaatgggagatcctatctctaccaaaaaaaaaaaaaattgtaaaaaatttgccaggcatggtggctcatgactgtggtcccaactacctgggaggctgaggctggaggatatgtaggcccaggaggtcaaggctgcagtgagcactgatcctgccaccgcattccggcctgggcaacagagcaagacccagtctctcacacacacacacacacacacacacacacacacacacacacacacacataaatgaaagattactgcctgttttgaactttgttttctatggagttgttcagcttttcctattagaagttcaaatatgtgtactacatattgtgccatttctgaattataacaaaagcaagagagcttagaaatcatccagcccagttggccgcagtggctcacgcctgtaatcccagcactttgggaggccgaggcaggtggatcacggggttaggagatcgagaccatcctggctaacacggcgaaacctgtctctactaaaaatacaaaaaattagccgggcgtggtggcgggcacctgtagtcccagctacttgggaggctgaggcaggagaatggcgtgaacccgggaggcgaagcttgcagtgagccaagatcgcaccactgcactccagcctgggtgacagagcgagactccgtctcaataaaaaaaaaaaaaaaaaaagaaatcacccagcccagtatcttgaattaacaaataagcaaaactatccaggcccaaagttattatttcaaattataataacttcagtattctctagttaggaggtattctcctcagtttaatttgaataaactaagtgctcactgaacacctgccacagtgaactgtaatgaataacgagcaaaagttggaagtctgtcttgagggtgctaaactcacagtccaaggccactgactaccatccaaaaccctacagtcattgggctcaagagcccacaaactcaacacctgctcagcaccagcctgcttaaacttgaagcaggaattttcaaaacagcctcctctttctttcagcaagtcatatgatattcattaactttcaaagcaatgagaaaatataatgtaagttaaaattaaccaagactgatagttacatgaagatgtctagttattgggtgttttcccccgctctctggtcctggctgaggcaagcggatcacttgaagtcaggaatttgagggtaaaaccctgtcactactcaaaatataaaaattagccaggtatggtagcacatgcttgtaatcccagctacctgggaggctgaggcaggaggaacacttgaacccaggaggcagaggctgcagtgagcttagatagtgtcactgcactccagcctgggtgacagagtgggactccatcacaaaaaaaaaaaaaaaaaaaaaaaagatggtgtttaaatttttattccaggaacagggttattctttttatattccaatttcaaaagaaaaactctctatatgttctgcatcaagctaataccacaattaaaacgtattcttcacatgatagagaatttaaaataatgatgacacaactagatacttgataatattaaggaattattcattttacatgtgataaacgtattacggcttaaaaagtcatcattttagagatactgaattatttatgaaataatacttgagatttgctataaaacagtgcaatgagggacgcaaaattgtgaacgtgcatgagagcaaagtatagataaaacaagtgggccacgtgttgataattgtgggaaccaagtaacatgatattctctccgtttttccgtatgctcaaatacctccatgataaaaagtaagccaaaaaataaaattatagtaacaaatcagccttctcagagggcataccacagaagcagtagcatcataattagttgttgtaaacacaggtattaaagagcacacagtgactgacagcattatattcatggatgctgctaccctgctgaagaaactgctgcatttgtcagtaccatagaaaggtcaaaaaaaaaaaaaaaagaaaagaaactgctgtatttcagcagcgtgagaggtgattcccatgactaatatccaaaattacatgacattacatccaaaatacattttatatcttagaaatctttctgagaaatcaacaatacttaacaagtatggaatgactataagatcatcaccattagctagatatttccaattcctaaccattcttttcctcaacaacctactccttcaacgagtgctgaagagagaaacaatggtcactggaaattcatcttttaaagttatagatatgaggttttaactcaaaaagaaggaatttcatcaagtattagatcatattcagctactgaaacaaattcatatttcctcgtttcatgttctcaaggcacaaaatactttaccttcatggtactcaggagcatttccttccttccttccttcttcccttccttcctccctccctccctcccttcctccttcccttctttcttctttctctctctctctctctctctcctcctctctttcttttagatggagtctcgctctgtcgccaggctggagtgcagtggcgtgatctcagctcactgaaagctctacctcctgggttcaagcgattctcctgcctcagcctcccaagtagctggaactacaggcatgtgctaccatgcccagttaatttttgaatttttagtagagaaggggtttcaccatgttggccaggatggtcttgattctcttgaccttgtgatccccctgcctcggcctcccagagtgctgggattacaggtgtgagccaccacgcctggccattctttcttttttaaagcaagaatttcatttaatgacctaggtggctttattctgattttcacttttaattatggtagacaaccaaatgatagatctctgaaattttgagacacaacttcttgtgtacaaagagaaatgcagggttctccatcttaagcccctaaagccttcaggagccttcattcacctgtgtaacatagggcctccaccttgatgccagccaacacacacatgtgctaagctgaagcagccatccctggaaccggaaagaatgagaagggaacacaactgtctcaagtttgaggcttccttcttgacaacaatattcacagtacaaaagtactgtgcttagaggagacgtaagtcagataagctgtaacttttcacaaaatgcacaattagtataaagtttaataattttttttcttccagtgtaaattcagtttgtttactgctttgtagttttgaaaagtcaggagttctttttaaattcttgggagctggtctgaatgtagtcaggtcacttttcttatcaaacagcaaaaacttattcgagattacataaaaatgggaaatataaacacatgttacatacagtccgtacactttgagagcatgtcatgccagttggaaaaacctaacagcaacttacaatggtaaatgatgactaccaaatgctctgaataggctgtacgcatgatgggagtaaagtgaagagggggtttaagccatgtgggtttttttgtttgtttaagagacaggatctcactctgtcacccaggccgaagtgcagtggtacaatcatagctcactacagccttaaactcctgggcccaaatgatcctcctaccttatcctgccatacggtagctaggactacaggtgcatgccagcacatcctgctaattgttattgtagaaacaggattgggtctcactgtgttgcccaggctggtctcaaactcctggcctcaaatgatcctcccaccttggccttccgaagtgttgggattacaggcaggagccacagagcccagctgggatttaattttgaaaaacagaggagaggaagagaattccaggcaggaggataaaagcaaaaacatagagatgacaacacacaacatgtgtttcaggcacagtgactagaccaatttggctggggtactttttctcctttgttgtcatctttatttttctacctgggatgtaaacgatgtgaatatgggtcagaaaaatcagctgcacagaaacacctcagccaattgtaagacagagagagggtggacatgcatgaaggggcagtagcaattccagaccagccttctgaaagagcctgtggtccaagccggcaaccagaagggcactctgggtggggcaggcaggaccatgcaatgcaggttcttgggaggaaggatgaggaggagcagtcacagcagatgctgtggctgagctccaacaagtttattggactctgccttcaagctgctgcctgaagaagttgattagcccattggcggaagcatagtgagaggtcacttcaaggcaagcaacaagaaaagactagaaagctaggttggagttagcctggaggccttatataccaagagtttgaatttcagactgaaggcttctgaatgggattaaaatgacaggaaagtaagcagcagtgcacatatacagagatcagagactgatgttcaggacggaatggggaggaagagcctggaggttagttctcaggggatgtttactttagcaatcataaagagtccaggcctggcgcggtggctcacgcctgtaatcccagcactttcggaggccaaggtgggcagatcacgaggtcaggagctcaagaccagcctgaccatcatggtgaaaccccgtctctactaaaaatagaaaaatcagccgggcgtgttggcacgtgcctgtaaccccagctactcaggaggctaaagcaggaaaatcacttgaacccgggagacagaggttgtagtgagccgagatcctgccactgtactccagcctgggcgacagagcaaaactccgtctcaaaaaaaaaaaaagtatacaggaggatgtgtgtagattatatccaaatattacgtcattttatataagggtcttgagcatctatgaattttggatatggaggggtcctggaaccaatcccctgcaaacaccaagggaagactgtacttcatttatgtaagcttccacagtttacaaaggacttttgcttacataatctcattttaccttcagaacaatttgtaaagtagaacatttgctatatttcacaagtgaggaattgctgctccgggcagttccttttatgaccaccattccatgtttcattttatggctctgtctctcaaccagtagactgtaagctccatgagggtatgcagggaccacactgaattttgtttgcctttgtagccctggctgcctcatgaagagccctggtccctgatcccagcagacacatgctcactaaatatgtgacagatgggtgaggagcacatcccctctcccactcttgtttcaatgatactaaaatgctttatcaatcaaaagtgtttgggggctttttgtgtttgttttaaattattgttctgacaattaaaaggctttgacaattttaatacctctacttagcactttctaaacaagacctcttttcccccgctaggtaggaaaaaggaaaaatatacaaaaaaggaatatcaggctgcctgccaccttcaccgttgtatcaaaaagtcactctaagtgatatattagactaaggaccaaaaaaaggtcaatatttgctaattattttttcaaatatcttctatttctttgcagaatggaatgtatgctgaaacaaataaccacacatatgagtacctacagtgccagagttgagaaattctggcctagaacacttgtgccagaaaacaagaaaatgctccaagaataatggagacatgtcaaaaggacaaagcagcagcttgaagggcctcccactggccaagtctgagacaatttaagcatcaatacaaataataaaagattatagctcattgattaaaataaaaaacatgagttcatattgatataaattaataaatcaataaattgaaaatgtgatgaagaatgagatagttaacataatttggaagtacttatccataaaataccaattacaaatggaagaataatttagcagtagaaaaatgcaaaaaattgaaattgtatgtcacctactaggaggcaatgagacataacatcatttctgccatatttctgccaaagatacgcaacctgagtttaatcatgagaaaacatgagacaaacccaaattgaaggacaggctacaaaataactggcttataatttccaacccatcaagaccatgaaagtcaaaagaaggctgagaaagacttggcaactaaaagcaaagcatgtgaatctgaactgaatccttttgcttgccccacccccgcaaaaaaaaaaaaaggcggtggggaaaggagctggaaggtctttattgggactattggtcaaacttgaatggggaatgggggggtgtgaggagtatttgatggtaatataatgtgtcaatgttaatttcctgcttttgatggttatgttgtacttatgtagaagaatgtccttaccattggaaacatacacacactagggtaattccagagtgatggagcatcaggcggacaactccaacggttctggagaagaaaacaagttttctctactgtacttgtaactattctgttttgggctgtttcaaaagttttcaaaaacattttaaatgattagtatctctccaaaatgaaagtaatggatacaatcttaatacatacacacaaattctttccaacaagaatgttctctttgtaaaagtactaaataagtcttccatttggtcactagggaagtagtataaaatagtgttgcataacaaaaaagaaaaaccaggctttccatgtagtaacactgacttcaagctccagttcatcacatacaaatttcatgaccctaggtagacttttttttttttttttgagatagagtctcgctctgtcacccaggctggagtgcagtggcgcgatctaagctcactgcaagctccgcctcccaggtttacttacaccattctcctgcctcagcctcccgagtagctgggactacaaggcacccgccaccacgcccggctaattttttgtatttttagtagagacggggtttcaccgtgttagccaggatggtctccatctcctgacctcatgatgtgcccacctcggcctcccaaagtgctgggattacaggcgtgagccaccgtgcccggccggaagattttgtttacccttctgggtcttgatatcctactctgtaaagtgagaataccagccaggcatggtggctcatgcctgtaatcccaactactcgggaggcttgaggtgggaggatcacttgagcccaggagttggagatcaatctgggcaacatagcaagaccctgtgtctataacaaggaagaaaatgaaaaaagaaaaaacaggaagtgagaataccacttttggctgggcacggtggcttatgcctgtaatcccggcactttgggaggctgaggtgggcagatcacttaaggtcgggagttcaagaccagccaggccaacatggtaaaaccccgtctgtactaaaaataaaaaattagcccagtgcatggtgacatatgcctgtaatctcagctactcgggaggctgaggcaggagaattgcttgaacccgggaggcagagattgcagtgagccgagatcacgccactgcactccagagactccatctcaaaaaataaataaataaataaaagaatccctcactttgaacaacaaaagttgttaatctgctgagaatacaggagaatacaagggtgggaggaaatctggtgctagataatacaatccttcactctttcagtaagtttggtttttaaacacatgaatcacttattcattcaacaaatatttacagttgacccttgaacaacacaggcgtcaggattaccaactgccctcacaggaaaaaatctgcatgtaacttctgactccccaaaactttactaatagcctacagctgaccagaagccttactgataacataaaccgtggattaacatgttttgtatatgtattatacactgtattcttacaataaaataaactagagaaaacaaaatattagaaaaattataaggaagagaaaatatatttactattcactaagtggaatggattatcataaaggttttcatcctcacggtcttcacactgagtaggctgaaaaggaagaggatgggttggtcttgctgtctcaggggttgcagaggcagaagaaaatccacataaagtggacccatgtgatttgccctgtgctgttcaaggtcaactatatttggtttctatactatgctctactatgtagcagctacagagatttaaaacatgatccctttgcctcaagccaataggaaacaagctaaaagcaagcaatcataatgaaaaggaaggatgttttaagtagtaaaggagaaagaaaaaagaaactcaaatggattctctcattctcaacaaacaagcaagtgaaacttctttgggtaaagagagaacaaccagaaagctattctggctcttcagtgctcctactgcaaggagtgcaagggggtgtggtgcaggaagcctgagctacctatcccaggggaggacaaagggagacaaaggcatcaagagagagcagctgggcagtgaccgaacatggctgccaggccaggggaaagtagcacatgggtcctgactgaaccctctgtggggctggtaagccctttctagtccagagatgcttttgggaggaggaggtgagtggcagaaagaaaattatacaagaaattttcttaatgttctttacacaatatacatggggaaaatgcacaagggggtaattgtggagccatgtttcaaagtaagatgacattcacttaatttgtacaaccagaatacagtgtgtttttctgtaatgatgttatttatagcctagtacttgtttgacagtacctgactgagaaagtgacaaacatctctgtatatatagaacttaacttataaaacatgtttaaataaggtaatttgcccaaagcttctccattgaattttaattccacaatatttgttataccatatcaacaaaatgacaccagataaaaaagaccactaagctcagaaacatctatttggtatctgtatcttcggaactgtcttccactcagtatttaccaacacagttaaaaaccagcatatttacaatgcttctttaccagcctgctagcaacttgtctctatctactactgagcacctcctttgttcttggtacttcccaggggatgatggggtggcccaataggaagctcagtcttg

SEQ ID NO: 242 - DNA, 14841 bp, Homo sapiens
aacagccatcatcaaaaatgtcagaatcatcaggaaagcataaaaaacaaagtctttccccaacggagtaacaggctctgcctcaacccagaagagagctgaggggaagttatagtggttgacttagagagacccttgggaggtccaatcactcaccaaactttaactcgtgattataagagaggatgctctggggattttgctgctttgtattgttacattaaacatacaagcatttttaaaagctctatgttagaatttaaagatgcctagactatagacacatatgctgtacaattaattcactggaattttttttaagtttaaggccctataagaactagattatcagttataaatattgagaacttttggataggctaccacccctcaaaaatcacgacaggcaaccatacaggtcagtccctcaagaacacctcaagaacctgtccctcaagaacgcctcccaactccagggtaatgctgctgcgagggtatcctcggggaaacacaatggtgaatgtctgctgcaaaacactgagccaatacctaagaggcatgctgaacatttaacaacaatgatactaggaacaagtattagttatttagaaaaagtataaattatttagaacacaaaacaactcttcaggagcttttaaagtaagtgcttccaaaaaaggagtaaatctctggttactactagagatgtactacgtaacacattaaatctgtaaaataatttggcacaaaaagttaaatggacatgaggaaaaaaaccagcctaggttatgataattaattaggaatctaaacagacttatatgcaagatgtaaaaccaaaaccctaactggcagaatagcagtctacttacttacctgttatttccaaagcgcagcaggacacttggcagccttctgtttggttagtattagaccctagtcacaccttaatagttgtttttatagatttcagtacccccacacctttcaatctaacatatgtaaacattctctgaaaaccaaaagtatctaatgttaaatatatagaaatttttggttaaatctctacacctgttaaacagaaagattcctcttcctgatttcttttctccacttttctattctttccttaaaaataatttggtttctttcctaccactaaattattattttgtgaacttaaatgcaatattacaaaggtggccagttttctaagattaggacttaccaattccactttacagtgcttagtacaaaattattggtataattttcaatccttaataatactatgctactaatggtcatgttttcatgtgttataagaaacatgccttttgggaggctgaggcaggagaatggtgtgtgaacccgggagccagagcttgcagtgagctcagattgtgccactgcactccagcctgactccatctcaaaaaaaaaaaaaaaagaaagaaagaaagaaagaaagaaacatgccttccataaaactattcctactaatgttcatgttttataagaaaaaaataaggccaggtgtggtggctcacacctgtaataccaacactttgggaggctgaagtgggcagatcacgaggtcaggagatagagaacagcctggctaacacggcgaaatgctgtctctactaaaaatacaaaaattagctgggcatggtggcgcgcgcctgtagtcccagctacttgggaggctgggagaattgcttgaacctgggagacagagggtgcagtaagccaaggtcacgccactgcactccagcctagtgacagagctagactccatctcaaaaaaaaaaagaaaaagaaaaaaatagtgtttacataatgtataacttctttcagccttggacaaaactatcattgaaacagacgtctgaagtcatccaaacaggccgacaagaatttaaaacttcattatttgcaaattaacaacgaaaaaggtaggcttaaggcagacaattggttactaatgtctccttcaaagggaaaaaatttccagcaccatctactaaaactgttcggatatattccaaaggctagttgtcttttaggatttttcttgggaggggttgttcattttaattgttgcatttaaaatgttcaaaaaataaatgggcttagttggtcaaaacacaaccactcactcaggaaaaacatcatcataaaggtaaaaataactcaaagcatacacccgaagtcattaaaaggtttttcctcagttttctcttataggatgtgagataaatgcagtattattctctattaaagtataaaagacaactcgactcagttgtctaactcacattaaattcctccaaaatggtattttgaagagtatcacaggctcagccacatcaagtttggaattttgtgacacagagtcagatgacagaacactcagtccttcctcacttggaaacaaaaaccaaatgcttgaagagacttaatgtcaaatctaactatgcaaagtcttaagtttacttcaatttcatctcaaagcaatctttaaagaaaaaaaatcaataagccattcaaacaccagaatactacttttctcggaatctttaacaaaacgtcaaacaaattcagactgttggactgttaaacttcaaagagccaccttaatattttgaaaacatcaagaaaaagttgagcaagaaagagaggaaagggagggagagaagaaggaaagaaggatggatggaaagaaggaaggaaggaaaagttttctcaactttaacaaatactattatcaaagctaaggagttttggccttgggaattcagatattacgcataaaacaaggaaataaacctaatgaacaaacattactactatggggtgatgtcaaccttgcaattttggagagagattaatgaagtggggtgaagtataaagagaataattttttcacttcaaatgatgagtaatgaagttcaacatataaacattttttgtttgctcattttttcccaaataactactttacacccacattactgtctcatttgcaaacgtctgcatagtatcttcagcaactatacctagcactgcatttttacatacattaagccagctgcctggatgattttttaaaattgctctttgtttcactgaataactgaggctggtgactctaaaagttagagaaaactttaataagtaacacccagtccaacagtcctcaacagttctgttgtacacaccattcccatgtgccaacatttcctcaaataacagctctccattaccctacagtgcttttctagagaattcttccctacctgctgtggtttgaatgttgtgtcccacccaaaattcacatgctgaaacttctttttttttttttttttttgagatggagttttgctcttattgcataggctgcagtgcagtggcacaatctcagctcactgcaacctccacctcttgggttcaagcaattatcgtgcctcagcctcccgagtagctggggctacagggaggcgccaccatgcctggctaatttttgtatctttagtagagacgggtttcaccatgttggccaggatggtctcgaactactgacctcaggtgatccgcccacctcggcctcccaaagtgctgtgattacaggcgtgagccacctcgcccagcctgcacgttgaaagttaatccctaatatgagagtattaagacgtgtggcctttcaggaagcgattggatcaatgccattataagaagcttctgagagctgcctgccccttcttgctttcacattcccttccaccttctaccacatgaggatgcaccatcaatgaggaatggcacctccccagacactaaatctgccagcaccttgattttggacttctcagactccagaatagtgagaaaataagtttctattattcataagttactgagtctcaggtgttctgtcatagcagcacaaatgactaaaacatcatccatccccgaggaggagattgtccatttctgtgttccaacaccatcaatgacacagggataaaaaactcccacgactaccttctaggataatctattccacttctaagcagctccgccacaaagcctgtccttaacctgctgcaaagtccctatggcttctgcccattgctgttgcccactcagaatgagtctgtgttcattcactcacacagagcccttcacatagctgagagaactaacgttcatcaactgttcttcctaagcaggtcctgagctgcctcaccttcctagtccctcctctaaaatacattccagtttatctgtagcccaaaacagaatacaaaagaataaagtattgtttataatacaaagggtaagtgtttgaggatggacacctctattttacattacgtgattattacacattctatgtctgtatcaaaacatctcacataccccataaatacatacacctctatgtagccacaaaaattaaaataaaaaaaatttttttaataataaattaaaatgttaaagtgattttgatttctgctttatatcgtgtatttctgtgactaggccaaacaggtcatgggtaaatctgctcagttaattagactttgatattgagctcttggtaatcagtcttaatggaacaaaaactactccttcctcagtatgtttccttaaactaaccaataatttcataaaagcagatcatctttcagaaggaaaaactaagggaaatcataggtgggttagcacactccacaatgtaaaggaaacaataaatatacattcccatgcaaaattcaattctctctcttcaaaactaccacagcattttgtgggaccctctagaagagcatttcacctggagtgattcaggcctacctgctcctcagggtctgggccccaccttcatctttctctatgattttacactgtgcctgacagtggtgagcttgcaacttctgtctgaatgaaactgatcaggagtagttctggcagctatttagatagaattggagtctcagcactcattatttatcatactcatcctttaatttaaaagagggccaagaaaaccaaattatttaaagatttcccaatttctgaaaatataatgctgtatcagttgttttttttttaagcagctcaaaaaatagcacatagagcaggtaaaaagggtaggaaaaatttttttctatgcaaaagccttaacatttataaacttcaaccaaatccctataaaaaacatgtagtttttgcactgtgtagtccatatgctaaatggacatgtttagttacatgttttcttgagcagtactttttatttgtagcaaagctattacatcttatacattatattacacgtaaaagtccattttaaaccaaattacttcaaaatttgacctatattacatctggcacagactagctgttctgctatactgtttaaatgcctgctatattcgcagcagttactttataaaacacataatctttatgtgctagcagtaaatttctatacctttaagggataattctaggctaatcaattagtataccaaccttccctatccccgaccccattcattcacttggccctgaccatgctaagcatctgctacatataactcctagtaggaggtacaactatgtagaaacactacaaagttactgtgacagtatttaaaacagatgcactgacagccaaaaaaaaggggaaaaaaatcccatacaaaaattgtgaaaagagttaagatacaaaagaaaaaaataacagtaaaatagcaagcgctcaatataatttatgtcaattttgtaacttttcttatttatacacaagatcaaggaaagaacagaaaatccttttataacaataaaacagtgtaagagacagaagcatcgtaagtcaaagctaaaaaaaagcaaccaattattatatactcattacaaaataatacactgggaaaaggtcgaaactgtaattggctcttataaagtagtaattcaggatatatacagtctatgactgtaaagcacatctttataatacaagtagaacactttcatacagtttccaacagaagggtttattcataagccattactgcagaggaaaacaacaacagacaaatcctcaacctgttaataagttcaaactgtttgccaattcaactgggaaataatgcattagaaaaaatacctacttgttaacaaagtcattgcatttgtaactaaagagatcacacacaactgtgccatctggtcacaaaacagaagataaggacaagtttctttttataaaagtattccagctaataaatgatgaaggaatgacagactctcttattaaattactggacctaggtgttgaccatcaataacagagacacatcaatcacaagagacaacctgaaacatcatgtgcctcttaatggaagaacacaacaccaactattgaactatctttcaaaaaaaaaaatcaaacttgaatctgattgagcttctaaacaccacagagaagttagaggaacatgtttgtttgttttttgagacggagtctcgctctgtggcccaggctggaatgcagtggggccatcttggctcaccacaatctccgcctcctggattcaagcaattctctggcctcagcctcccaagtagctgggattacaggtgtgcaccatcacgcccagctaatttttatatttttagtagagatggggtttcactgtgttggccgggctggtctcaaactcccgacctcaggtgatctgcccaccttggcttcccaaagtgctgggattacaggcatgagccactacgccccgcctagaggaacatgttaaccaccacaatggtgagccaatcagcaaaatcaaactctggaaaacaccattaagacaaactacctggttttatcaaacaaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaagtttggaatgcaatgggcacgatcactgctcactgcagccttgacctcctgggctcaaataatcctcccattctcagcctaccaagtagctaggactacaggcatatgccaccatgccttgctaactttgtttatgttttgtagagaagtggtcgaagtggtctcactatgctgccaggctggtctcaaactcctaaactcaagtgatccttctgcctcagcctcccaaagtgctgggattacaagtgtgagctattgcacccagcctggcaaataactttaaaacatgacaccagaaaaagcacaaacaataaattgggactgtatcaaagtttaaaacgtttgctcttcaggccaggtgccaccccccagctcacgcctataatcttagcactttgggaggctgaggcgggtggatcacctcaggtcaggagttcgagaccagcctggccaacatggtgaaaccccgtctctactaaaaatacaaaaattagccaggacagtggtatgtgcctgtagtcccagttacttaggaggctgaggcagaagaatcacttgaacccgggaggcggaggttgcagtgagccaagatcacaccactacactctagcctgggcaacagggtgagactccatctcaaaaaaaaacaaaacttttgctcttcaaagacacaatgaagaaaaaagacaagccagaggcttaaaaagaaatttttttgcaaaacatatacctaatatggatttatatcaaaaagctcttaaaaataaacaatcctttttttttttttttttttttttgagacagggtctccctctggtcactgggctgcagtgcagtagcaccatcttggctcactgcagcctcaacctcctgggttcaagtgatcctcctgcctcagacctgccaagtagctgggactacaggcgcacgccaccacacccagctaatttttgtatttttttagtagagacagagtttcacctattacccaggctggtctcgagttcctgagctcaagcgatctgcccacctcagcctcccaaatgctaggattataggcatgaggcaccacacccggacaataatccaatttttcaatcaaaagatttgaataggtacttcagcaaagaaaatatatgaatggcaagcacatgaaaagataattagtcactagggaaatacaaattaaaaccactatgaagtatcattacacaccaactaaaatggctaaaatacgaacaataggaaatttaataaggatggagaagtgagtcctcatacaatgctggtgcaaatgtaaaaatggtacagccactttgaaaatggtttggcaatttcttaaaaagctaaacacaggccgggcacggtggctcacgcctgtaatcccagcactttgggaggcagagatgggcagatcatgaggtcaggagattgagaccatcctggctaaaacggtgaaaccccatctctactaaaaatacaaaaaattagccgggcgtagtggcggtcgcctgcagtcccagctactccggaggctgaggcagaagaatagcttgaacctgggaggcggagcctgcagtgagccgagatcgcaccactgcactccagcctgggcgactgagcgagactcagtctcaaaaaaaaacaaaaacaaaaacaaaaaaaaagctaaacatagacttatcatacaaccaagcaattccactcttgaggatcaccaaaaagaaatgaaaacagccacacaaagactttacttgtgttcactgccaagaactagaaataacccaaatgtccatcaactagtgaatggataaacaaaacgttttacctatttatacaatggaattattctcccagcactttgggaggccgaggggggcggatcacgaggtcaggagatcggtaccatcctggctaacactgtgaaacccgtctctactaaaaacacaaaaaattagtctgatgtggtggcaggcacctgtagtcccagctactcgggaggctgaggcaggagaatggcgtgaacccagaaggcggagcttgtagtgagccgagatcatgccactgcactccagcctgggtgacagagcgagagtccatctcaaaaaaaaaaagaaaaggaattattctcagcaataaaaacaaactactgatacatgcaataacaaggataaatctcaaaaacttcatgctatatgaaacatgccagacacaaaagactacatattggatgattctatttatgtgaaatttctagaaaaggcaaaattgtatagaaaatacatcagtggtttcccagaatcaggatgcattgtctgtaaatgaccacattttgggggtaataaaatgttctaaaactaaatggtgatgatggttgcataactctatacaattactaaaattcatcaagtaggtcacttacaatataaaacatgcttcaataaaacattgtttaaaaaaagagagaagataacacaacgtgttggtcaattggatcctttaaacaatattttttaaatttatttttgttattgtaaaatacacataaaatttaccattctaatcaccttagatgtatagttctgtggcattaaggacattcacaatgttgtacaagaaaattttttaaattacagcatgtataacaatgggaactgagctctgcataaattctagtgttcataagaaaaaatgtagatcaggtcgggcacggtggctcacgcctgtaatcccagcactttgggaggccaagacgggcagatcacgaggccaacacggagaaaccccgtctctactaaaaatacaaaaaatttgccgggcgtggtggcgggcgcctgtagtcccagctactccggaggctgaggcaggagaatggcatgaacccaggaggtgaagcttgcggtgagccgagatcgcgccactgcactctagcctgggtgacagagagagactccgtctcaaaaaaaagaaaagaaaagaaaaaatgtagatcaataatattattttgctgacgcattggagaaagtaaaggctgggtgcagcttcaagctgaggaccacccaccatgcccccatcatggtggttcccctaggtgctgaagggcccagccatagctctcgccctcgcagggtccctccagggtctctgctgtttcctacctaggggtgactgcagccatggctaagaaagcgccagcgcccacccacctgggccaatggactggttctgctcgtgccacgctggttctgctcctcgccatctcggcagttcagaaagaaccccaacgagcttgtgatctcccgggtcctgtgggcgtatcaacagggggccagccctgtccctcaaccctggggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcctctgaccaggcctgcggggaggagccacccacgcgccacagcaagtcctggacctggccctgcattccagggtggggcagggaggctggattctgagagagctgcttccggattgcgttggggtagtcaaggagctcgggacatcgcaggggaggcaaaaagccttggccagtgctcttttggtgtatcccttcagcttccagaggggaagccacaccctgatgctatgttcaaacgctccagaagacaggagttcgtgtccttgcccctaaccactgctgtggatgtcactggccaaaggtcatgaggggagtgggccacatgagtggccacttgccatgactccctgagcagggtgagcccccactcatcctgtgccatgttatgtttccacccaagcagcagggtaggaggcacaatgagtgcccattcctctccctgatgggccccccaagctctacagaccaagcaaggagaccccatgacccatggcatgaaatcatcttgaagtttttgctttttttttggagacagagtatcgctctgtcgcccaggctggaatgcagtggcacaatctcggctcactgcaacctctgcctcccgggttcaagcaattctcctgcctcagcctcatgagtagttgggactacaggcatgtgccaccacatcagcccggctaattttttgtatttttagtagagacagggtttcaccgtgttagccaggatggtcttgatttcctgacctcgtgatccgcccaccccggcctcccaaagtgctgggattacaggcgtgagccaccgcacccagcctactcttacatttttttaggtttttatttactcactgctttaagcatacacgacacttcggttttattcctccctttgtaatgttttttctcttaagccacttttttttttttttgcaatgccttcctctttgaaagcattaaaaaaacagtattttgtttatgtttcaacaacaacaaagaggacttaatgtctggcacactaaaatatttaccaataaaacaaactgatatttggaatttttttaagttttaaaagtgtggtcactgtattgtgatcacacaattacattaggaaaatgtcttattcttagagatgtacattaaagtattaagagtactgagttataatgtctgcaatagagcctcaaatgtttcacaggggactatataaatacatatatatgcctatatatacatatattacatatatacacatatataaaagacaaagagagaaagcaaacagtgattctaggtgaaagacaaagtgagaactcagcaaaaacgtaaattagtacaggtttgttggaaagcaatgtgatgacatctcaaaattggaagaaatttacaaaaactaaaacatgcctaatgcatgtcctttgacccaacaccccttctaggaatttatctttaaaaaactcacacaagaccacaaagcaagaaagggtattaattacaaaaattttttaatggtttaatactcaaatatctaccaataggtggttaggtaaataagttattgcaaatgcttaaaatgaaaaaaaatatatgaaaagaagaaaggggtgtgggtacagatgaaaccgcattggctgtgagtttattacagaagcaatctttgaataatggatatttggatgttcatctcactgtttagtctacttttatatatgtttgacattctccctaacaagtcaaaaacaaaaaagaaccacacaaaattccaagggcacaattctttacaagtggtcatcgaccccctttctttcccaaattaataatatcaacatgggagggaaggttctacactacataaacaagtacacataaatattaaagttctttcagcctgggcaacatagtgagaccctgtctcttaaaaaaagattttcttttagttagctaggtgtggtgattcacatctgcagtcctagctactagagagactgagacagaaggactgcttgagctcaggagttcaaggctgcagtgagccatgatcgtgtgtcactttagcttgcatgacagagtgagactccaactcttcaaaaaagaaaaagttccatcactcttaattattcttacatcctcaggtcatccctgaacagaagagttttgctttcaagcatcttggatccagtagtaagtagatggcagctcacatttactgtgctcccaccagcaagcagctcttcatttctaatagctctagctaaggaaagaaacaagtgtagaaaaagccaggcacagtggccgcgcctgtaaattttagcactttagaaggccaaacaaagcaggaggaccacttgagcccaggagtttgagaccagcctggacaacatagggaaatgggagatcctatctctaccaaaaaaaaaaaaaattgtaaaaaatttgccaggcatggtggctcatgactgtggtcccaactacctgggaggctgaggctggaggatatgtaggcccaggaggtcaaggctgcagtgagcactgatcctgccaccgcattccggcctgggcaacagagcaagacccagtctctcacacacacacacacacacacacacacacacacacacacacacacacataaatgaaagattactgcctgttttgaactttgttttctatggagttgttcagcttttcctattagaagttcaaatatgtgtactacatattgtgccatttctgaattataacaaaagcaagagagcttagaaatcatccagcccagttggccgcagtggctcacgcctgtaatcccagcactttgggaggccgaggcaggtggatcacggggttaggagatcgagaccatcctggctaacacggcgaaacctgtctctactaaaaatacaaaaaattagccgggcgtggtggcgggcacctgtagtcccagctacttgggaggctgaggcaggagaatggcgtgaacccgggaggcgaagcttgcagtgagccaagatcgcaccactgcactccagcctgggtgacagagcgagactccgtctcaataaaaaaaaaaaaaaaaaaagaaatcacccagcccagtatcttgaattaacaaataagcaaaactatccaggcccaaagttattatttcaaattataataacttcagtattctctagttaggaggtattctcctcagtttaatttgaataaactaagtgctcactgaacacctgccacagtgaactgtaatgaataacgagcaaaagttggaagtctgtcttgagggtgctaaactcacagtccaaggccactgactaccatccaaaaccctacagtcattgggctcaagagcccacaaactcaacacctgctcagcaccagcctgcttaaacttgaagcaggaattttcaaaacagcctcctctttctttcagcaagtcatatgatattcattaactttcaaagcaatgagaaaatataatgtaagtt

SEQ ID NO: 243 - DNA, 9879 bp, Homo sapiens
aacagccatcatcaaaaatgtcagaatcatcaggaaagcataaaaaacaaagtctttccccaacggagtaacaggctctgcctcaacccagaagagagctgaggggaagttatagtggttgacttagagagacccttgggaggtccaatcactcaccaaactttaactcgtgattataagagaggatgctctggggattttgctgctttgtattgttacattaaacatacaagcatttttaaaagctctatgttagaatttaaagatgcctagactatagacacatatgctgtacaattaattcactggaattttttttaagtttaaggccctataagaactagattatcagttataaatattgagaacttttggataggctaccacccctcaaaaatcacgacaggcaaccatacaggtcagtccctcaagaacacctcaagaacctgtccctcaagaacgcctcccaactccagggtaatgctgctgcgagggtatcctcggggaaacacaatggtgaatgtctgctgcaaaacactgagccaatacctaagaggcatgctgaacatttaacaacaatgatactaggaacaagtattagttatttagaaaaagtataaattatttagaacacaaaacaactcttcaggagcttttaaagtaagtgcttccaaaaaaggagtaaatctctggttactactagagatgtactacgtaacacattaaatctgtaaaataatttggcacaaaaagttaaatggacatgaggaaaaaaaccagcctaggttatgataattaattaggaatctaaacagacttatatgcaagatgtaaaaccaaaaccctaactggcagaatagcagtctacttacttacctgttatttccaaagcgcagcaggacacttggcagccttctgtttggttagtattagaccctagtcacaccttaatagttgtttttatagatttcagtacccccacacctttcaatctaacatatgtaaacattctctgaaaaccaaaagtatctaatgttaaatatatagaaatttttggttaaatctctacacctgttaaacagaaagattcctcttcctgatttcttttctccacttttctattctttccttaaaaataatttggtttctttcctaccactaaattattattttgtgaacttaaatgcaatattacaaaggtggccagttttctaagattaggacttaccaattccactttacagtgcttagtacaaaattattggtataattttcaatccttaataatactatgctactaatggtcatgttttcatgtgttataagaaacatgccttttgggaggctgaggcaggagaatggtgtgtgaacccgggagccagagcttgcagtgagctcagattgtgccactgcactccagcctgactccatctcaaaaaaaaaaaaaaaagaaagaaagaaagaaagaaagaaacatgccttccataaaactattcctactaatgttcatgttttataagaaaaaaataaggccaggtgtggtggctcacacctgtaataccaacactttgggaggctgaagtgggcagatcacgaggtcaggagatagagaacagcctggctaacacggcgaaatgctgtctctactaaaaatacaaaaattagctgggcatggtggcgcgcgcctgtagtcccagctacttgggaggctgggagaattgcttgaacctgggagacagagggtgcagtaagccaaggtcacgccactgcactccagcctagtgacagagctagactccatctcaaaaaaaaaaagaaaaagaaaaaaatagtgtttacataatgtataacttctttcagccttggacaaaactatcattgaaacagacgtctgaagtcatccaaacaggccgacaagaatttaaaacttcattatttgcaaattaacaacgaaaaaggtaggcttaaggcagacaattggttactaatgtctccttcaaagggaaaaaatttccagcaccatctactaaaactgttcggatatattccaaaggctagttgtcttttaggatttttcttgggaggggttgttcattttaattgttgcatttaaaatgttcaaaaaataaatgggcttagttggtcaaaacacaaccactcactcaggaaaaacatcatcataaaggtaaaaataactcaaagcatacacccgaagtcattaaaaggtttttcctcagttttctcttataggatgtgagataaatgcagtattattctctattaaagtataaaagacaactcgactcagttgtctaactcacattaaattcctccaaaatggtattttgaagagtatcacaggctcagccacatcaagtttggaattttgtgacacagagtcagatgacagaacactcagtccttcctcacttggaaacaaaaaccaaatgcttgaagagacttaatgtcaaatctaactatgcaaagtcttaagtttacttcaatttcatctcaaagcaatctttaaagaaaaaaaatcaataagccattcaaacaccagaatactacttttctcggaatctttaacaaaacgtcaaacaaattcagactgttggactgttaaacttcaaagagccaccttaatattttgaaaacatcaagaaaaagttgagcaagaaagagaggaaagggagggagagaagaaggaaagaaggatggatggaaagaaggaaggaaggaaaagttttctcaactttaacaaatactattatcaaagctaaggagttttggccttgggaattcagatattacgcataaaacaaggaaataaacctaatgaacaaacattactactatggggtgatgtcaaccttgcaattttggagagagattaatgaagtggggtgaagtataaagagaataattttttcacttcaaatgatgagtaatgaagttcaacatataaacattttttgtttgctcattttttcccaaataactactttacacccacattactgtctcatttgcaaacgtctgcatagtatcttcagcaactatacctagcactgcatttttacatacattaagccagctgcctggatgattttttaaaattgctctttgtttcactgaataactgaggctggtgactctaaaagttagagaaaactttaataagtaacacccagtccaacagtcctcaacagttctgttgtacacaccattcccatgtgccaacatttcctcaaataacagctctccattaccctacagtgcttttctagagaattcttccctacctgctgtggtttgaatgttgtgtcccacccaaaattcacatgctgaaacttctttttttttttttttttttgagatggagttttgctcttattgcataggctgcagtgcagtggcacaatctcagctcactgcaacctccacctcttgggttcaagcaattatcgtgcctcagcctcccgagtagctggggctacagggaggcgccaccatgcctggctaatttttgtatctttagtagagacgggtttcaccatgttggccaggatggtctcgaactactgacctcaggtgatccgcccacctcggcctcccaaagtgctgtgattacaggcgtgagccacctcgcccagcctgcacgttgaaagttaatccctaatatgagagtattaagacgtgtggcctttcaggaagcgattggatcaatgccattataagaagcttctgagagctgcctgccccttcttgctttcacattcccttccaccttctaccacatgaggatgcaccatcaatgaggaatggcacctccccagacactaaatctgccagcaccttgattttggacttctcagactccagaatagtgagaaaataagtttctattattcataagttactgagtctcaggtgttctgtcatagcagcacaaatgactaaaacatcatccatccccgaggaggagattgtccatttctgtgttccaacaccatcaatgacacagggataaaaaactcccacgactaccttctaggataatctattccacttctaagcagctccgccacaaagcctgtccttaacctgctgcaaagtccctatggcttctgcccattgctgttgcccactcagaatgagtctgtgttcattcactcacacagagcccttcacatagctgagagaactaacgttcatcaactgttcttcctaagcaggtcctgagctgcctcaccttcctagtccctcctctaaaatacattccagtttatctgtagcccaaaacagaatacaaaagaataaagtattgtttataatacaaagggtaagtgtttgaggatggacacctctattttacattacgtgattattacacattctatgtctgtatcaaaacatctcacataccccataaatacatacacctctatgtagccacaaaaattaaaataaaaaaaatttttttaataataaattaaaatgttaaagtgattttgatttctgctttatatcgtgtatttctgtgactaggccaaacaggtcatgggtaaatctgctcagttaattagactttgatattgagctcttggtaatcagtcttaatggaacaaaaactactccttcctcagtatgtttccttaaactaaccaataatttcataaaagcagatcatctttcagaaggaaaaactaagggaaatcataggtgggttagcacactccacaatgtaaaggaaacaataaatatacattcccatgcaaaattcaattctctctcttcaaaactaccacagcattttgtgggaccctctagaagagcatttcacctggagtgattcaggcctacctgctcctcagggtctgggccccaccttcatctttctctatgattttacactgtgcctgacagtggtgagcttgcaacttctgtctgaatgaaactgatcaggagtagttctggcagctatttagatagaattggagtctcagcactcattatttatcatactcatcctttaatttaaaagagggccaagaaaaccaaattatttaaagatttcccaatttctgaaaatataatgctgtatcagttgttttttttttaagcagctcaaaaaatagcacatagagcaggtaaaaagggtaggaaaaatttttttctatgcaaaagccttaacatttataaacttcaaccaaatccctataaaaaacatgtagtttttgcactgtgtagtccatatgctaaatggacatgtttagttacatgttttcttgagcagtactttttatttgtagcaaagctattacatcttatacattatattacacgtaaaagtccattttaaaccaaattacttcaaaatttgacctatattacatctggcacagactagctgttctgctatactgtttaaatgcctgctatattcgcagcagttactttataaaacacataatctttatgtgctagcagtaaatttctatacctttaagggataattctaggctaatcaattagtataccaaccttccctatccccgaccccattcattcacttggccctgaccatgctaagcatctgctacatataactcctagtaggaggtacaactatgtagaaacactacaaagttactgtgacagtatttaaaacagatgcactgacagccaaaaaaaaggggaaaaaaatcccatacaaaaattgtgaaaagagttaagatacaaaagaaaaaaataacagtaaaatagcaagcgctcaatataatttatgtcaattttgtaacttttcttatttatacacaagatcaaggaaagaacagaaaatccttttataacaataaaacagtgtaagagacagaagcatcgtaagtcaaagctaaaaaaaagcaaccaattattatatactcattacaaaataatacactgggaaaaggtcgaaactgtaattggctcttataaagtagtaattcaggatatatacagtctatgactgtaaagcacatctttataatacaagtagaacactttcatacagtttccaacagaagggtttattcataagccattactgcagaggaaaacaacaacagacaaatcctcaacctgttaataagttcaaactgtttgccaattcaactgggaaataatgcattagaaaaaatacctacttgttaacaaagtcattgcatttgtaactaaagagatcacacacaactgtgccatctggtcacaaaacagaagataaggacaagtttctttttataaaagtattccagctaataaatgatgaaggaatgacagactctcttattaaattactggacctaggtgttgaccatcaataacagagacacatcaatcacaagagacaacctgaaacatcatgtgcctcttaatggaagaacacaacaccaactattgaactatctttcaaaaaaaaaaatcaaacttgaatctgattgagcttctaaacaccacagagaagttagaggaacatgtttgtttgttttttgagacggagtctcgctctgtggcccaggctggaatgcagtggggccatcttggctcaccacaatctccgcctcctggattcaagcaattctctggcctcagcctcccaagtagctgggattacaggtgtgcaccatcacgcccagctaatttttatatttttagtagagatggggtttcactgtgttggccgggctggtctcaaactcccgacctcaggtgatctgcccaccttggcttcccaaagtgctgggattacaggcatgagccactacgccccgcctagaggaacatgttaaccaccacaatggtgagccaatcagcaaaatcaaactctggaaaacaccattaagacaaactacctggttttatcaaacaaattggaaagaaaaaaagagcaagaaattgaaaaggacactataggttaaaagagatttaaaatgaaattttaaaaacaatttgaaaaaaatctattcactgtagcatcaagaaagaaagaaagaaagaaaagaaagcaagaaaaaaaaaaggaaaaggaaagaaaaggaaaagaaaagcctgtacactgaaactggaaaatatggcttagttaactaaaaaaatacctaaataaatggagaggcatacgatattcacagactaaaagatccaaagatgccaaaggtaattcaatggaaatggaaaaaggatagtattttcaacaaatggtacagaaacaactggatatccacatggacaaaaatgaacctcaaccttacctcataccatacataaaaactcaaaatggaccataaacctaaatgtaagagccaatattttttaatatccagaaaaagaaaatagaaaatctttctgagcttggactggcaaagaatttttatttttattttgaggcagggtcttgctctgtcgccaagtttggaatgcaatgggcacgatcactgctcactgcagccttgacctcctgggctcaaataatcctcccattctcagcctaccaagtagctaggactacaggcatatgccaccatgccttgctaactttgtttatgttttgtagagaagtggtcgaagtggtctcactatgctgccaggctggtctcaaactcctaaactcaagtgatccttctgcctcagcctcccaaagtgctgggattacaagtgtgagctattgcacccagcctggcaaataactttaaaacatgacaccagaaaaagcacaaacaataaattgggactgtatcaaagtttaaaacgtttgctcttcaggccaggtgccaccccccagctcacgcctataatcttagcactttgggaggctgaggcgggtggatcacctcaggtcaggagttcgagaccagcctggccaacatggtgaaaccccgtctctactaaaaatacaaaaattagccaggacagtggtatgtgcctgtagtcccagttacttaggaggctgaggcagaagaatcacttgaacccgggaggcggaggttgcagtgagccaagatcacaccactacactctagcctgggcaacagggtgagactccatctcaaaaaaaaacaaaacttttgctcttcaaagacacaatgaagaaaaaagacaagccagaggcttaaaaagaaatttttttgcaaaacatatacctaatatggatttatatcaaaaagctcttaaaaataaacaatcctttttttttttttttttttttttgagacagggtctccctctggtcactgggctgcagtgcagtagcaccatcttggctcactgcagcctcaacctcctgggttcaagtgatcctcctgcctcagacctgccaagtagctgggactacaggcgcacgccaccacacccagctaatttttgtatttttttagtagagacagagtttcacctattacccaggctggtctcgagttcctgagctcaagcgatctgcccacctcagcctcccaaatgctaggattataggcatgaggcaccacacccggacaataatccaatttttcaatcaaaagatttgaataggtacttcagcaaagaaaatatatgaatggcaagcacatgaaaagataattagtcactagggaaatacaaattaaaaccactatgaagtatcattacacaccaactaaaatggctaaaatacgaacaataggaaatttaataaggatggagaagtgagtcctcatacaatgctggtgcaaatgtaaaaatggtacagccactttgaaaatggtttggcaatttcttaaaaagctaaacacaggccgggcacggtggctcacgcctgtaatcccagcactttgggaggcagagatgggcagatcatgaggtcaggagattgagaccatcctggctaaaacggtgaaaccccatctctactaaaaatacaaaaaattagccgggcgtagtggcggtcgcctgcagtcccagctactccggaggctgaggcagaagaatagcttgaacctgggaggcggagcctgcagtgagccgagatcgcaccactgcactccagcctgggcgactgagcgagactcagtctcaaaaaaaaacaaaaacaaaaacaaaaaaaaagctaaacatagacttatcatacaaccaagcaattccactcttgaggatcaccaaaaagaaatgaaaacagccacacaaagactttacttgtgttcactgccaagaactagaaataacccaaatgtccatcaactagtgaatggataaacaaaacgttttacctatttatacaatggaattattctcccagcactttgggaggccgaggggggcggatcacgaggtcaggagatcggtaccatcctggctaacactgtgaaacccgtctctactaaaaacacaaaaaattagtctgatgtggtggcaggcacctgtagtcccagctactcgggaggctgaggcaggagaatggcgtgaacccagaaggcggagcttgtagtgagccgagatcatgccactgcactccagcctgggtgacagagcgagagtccatctcaaaaaaaaaaagaaaaggaattattctcagcaataaaaacaaactactgatacatgcaataacaaggataaatctcaaaaacttcatgctatatgaaacatgccagacacaaaagactacatattggatgattctatttatgtgaaatttctagaaaaggcaaaattgtatagaaaatacatcagtggtttcccagaatcaggatgcattgtctgtaaatgaccacattttgggggtaataaaatgttctaaaactaaatggtgatgatggttgcataactctatacaattactaaaattcatcaagtaggtcacttacaatataaaacatg

SEQ ID NO: 244 - DNA, 29757 bp, Homo sapiens
tggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 245 - DNA, 53626 bp, Homo sapiens
tttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 246 - DNA, 22303 bp, Homo sapiens
tggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgccttt

SEQ ID NO: 247 - DNA, 30909 bp, Homo sapiens
cttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagat

SEQ ID NO: 248 - DNA, 31074 bp, Homo sapiens
tggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatgagtcagtgaagaaaagaatgaaagtttactgtttagcagtgtggatctctaatccgacttaaaactccttgttcccgattcctattcctcctaagccagagatccctgggtccagggtgagggcacggcattcatgcttacccacgggctggtcaacaaagaggtgctgacctgagagtagggcacataacctcagccactggggtacacttaccacccccgcccccgtgtagctccctcccctatcctgaaatctcccttagcacactaagtattctaggttaaacagcccagatgttcagggagttcattcgccacaaacacacattaaaatgcagacaatttgcctgtgagatgaggaaaattctctggaagatttaggccctgagagctgaaaagggaccctaaacattacctggtgacaactgccctgaggccagagaagagaactcacaatattggtatattaaccggtaccatttgtagttaggctgtcattaatctgggtgtaatggggctcagctacagagaagcgtatccagaggaaatgtggggttcctgcagtcagctggggcaccgaaaagacccagactttagaaccagataaaggctgagttcgaacctctggttcttttgtgatgtggtgaccttgggcaaattaatgtgtgaacctcagtttcctcaactataaaatgtaatgaacaatacctaccacttactattgctgtgaggaagaaaagagagtcaacatgtaccgtgtacagattattgatgtaattcaatggttcttttccccatcctcctaggaggtcactggggagacagggggcagggtcagcccagtgccaaaggatgggcaggatctgaagtgtggaaatggagtaaggctgtgtctgtgtcagaggtgggttgggaagatgtgagacaaacatcacaattttgcctaaggtgaatccaacccacaagtagagcacaggccaacagcagctcactagtacacatacttacaccagcagctcactagtacacacacttacaccagacgctcactggtacacactcacaccagagctcattagaacacacacaccgtcagcttgctagtacacacacttacaccagaagctcactagtatacacttacaccagaagctcactagtacacacacttactccagaagctcactagtacacacacttacacccacagagacaagccccacaccacacggactcacaaatgcagaagaagagttgaccctgccctcatgtacagatagtatgctggtgtgtagtgagaggcggctagtgttcgcca

SEQ ID NO: 249 - DNA, 30933 bp, Homo sapiens
cttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaa

SEQ ID NO: 250 - DNA, 55974 bp, Homo sapiens
aaggagggttaaggagcatcctccggtggaatccttttgactcttcccaaccccattaccaccaacctctgaaacagaaaggtcctgggtctcacaacttcactgacccccatccctctcctgcccatgtgatatggccacacaccccacccgatgcctccagagctgcccatgagcagggagcttgaggaccctggggaaagtaagatgggtgtcccagctgtgggagaaggtcttcaccatgcctgccctgcccatcagccgcatccaggtgagactgggagagcacaacatcgaagttctggaggggaatgagcagttcatcaatgcagccaagatcatccgccaccccaaatacaacagttggactctggacaatgacatcctgctgatcaagctctccatgcctgctgtcatcaatgcccacatgtccaccatctctctacccaccgcccctccagctgctggcaccaagttcctcatctctggctagggcaacactctgagctctggtggtgagtgggaccctttgtccttctccttccctccatcctcacaatttccagaacaaaccatgccccttaacttgaatcctctcacctccaggcttaagacacatttctagtgcccattacacacaggctgtacagtggatggacatcagagagatgcaaagtctcaaggacttggctcctaaaatcaaaagacaggacatatagagaacttgctttgatcacgtcttggaaggggttcaaaaatgatcattctgggaactaaaagccagagtcccttgccaggacttaggtttcggagtcctctccagggacagtgttcctcttcaatgttccatcctagattattgtctccttctctggcctgatctacacttctactttctttgttctcttgctgatcctcacagccaactatccagatgagctgcagtgcctggacactcatgtgctgacccaggctgactgtgaagcctcctaccctggagagattaccaacaacatgttctgtgtgggtttccttgagggaggcaaggattcctgccaggtggtttgaccccttcccatgctgaggttcccactgatacccaggccccacccaggaaaaagatttgaactcccaaggtggcggggctcaggaggctccctgcactgcccccatggagaagtgaggaagactcccttgggctgcatcctgtctgcttaggaagaacagagaatgggccactgtgcgaaggacgtggagccaaagagctggctggaaaggagtcttttaaggttcagagcaaatgtagctatattcttcctctttctctctcttcatacagcttgtcccttcttctccccagggtgactctggtggccctgtggtctgcaacggacagctccaaggagttgtctcctggggctatggctgtgcccagaagaacaggcctggagtctacaccaaggtctacaactatgtggactggattaaggacaccatagctgccaacagctaaagcctctggtacctctgcagtctctataccaataaagtgaccttgctttcactgtctgtgtctgtgcctgctccctcacactgcttcacactggaaagcatcctccaatctcaggtcagccacgactcccccccttaaaggtaagctgaaccctcatctcccaaaatgtgttgcatggtacactagattagcacatacaaatagatggaatccaaaaattataagaaacttgggagaaaggggggcactgttttctagagaaatgtgtgtttcagaaagttggtctttggtgggggggtactgatttttatttgggcttctcacagtgggtagagctactctgccttcagaacaatcacagcacagaaaatgttgtcagcatcttcgaggcagcccaaaaaatccgaccagctgaatcttcttgctaaaatacatcaaaaaagacaaatgctgttggtgatgacgtgcctctcacaggaatatgtcagcaccaaaccctcaaccaagccctccctcctcattcacctggaaaattagactcaagcaaagctccctggcctcctacctcttccctcagttccctagttccatctctgtgagcaggctagagagatgttccacctaccatagcgggagctagactgcgacttgggaatcaagccaggtctgcacgctgcattttcatcttctttgcctttggggtaggacgccatatgaatcccacagttaacaccagctccccactctgaccagggaaagaaactagagagggtcaagattcacccatttgatcaattaactgaggtaggtttcattttcatataacttgcttgcctttgagatacttcaagtgacttacgtgggactccttaaaaaaaagtggagggaaagacatctgagcagccactctggccacatgttggctggcttgcacccactggatgcagcagagggaggcaggccccctggcacctctggcacctgccaaagcctcttccaggcaattctgagagggaccatgttggggctgtagctcatccaagcttgtcactgaagatccaagcaagcttctctttgaaattccaccttcatcttctgtcccaagtggttgtggacacccctgggagctggtaacaagggccaggagcagccaaggaagacagacaagttcagagcacatttccagttacagggaacagagcacaggcctccaagtgtccacagagcagtgtgcaaattgcagggatgagtagaggaaaacctctacatggagcacagcattcctggcaaacacaagggaccgcagtccacatgctgtggaataaacccaagtatgcatcggacacttgtttggtaaacagtaaatgtgtaagatcaattaccttgagagggccatctgggctccagatatgtagttcatgtgaggagacggctaccactcactatcttcagaggaaaacagggctcagggcttgcacacaatggagatacacacaggtcacccagaacgtcaatacatacaaacatcactttgttcaacatggattttgtttttatggagtccaaacgcagaccgtagttcaccttacagccttgggtttgtctgcttttggagacatatatccagtagatagatagacaacacagatacatttttttccctttcttactgtaacgtcagtgcctcgtctgaatatcatcatcactcaagaatcaagggaagaacaaaatgcttcatataaacagggctgggcaaggagtcttagtttcccctgttttctgtctccattcagatcattcctatcaaagcccagctggttacctcaagccaagagacagacataaggatcccaatggccttctagatggctgcttccacctcctacctgggccacatagagtctttacacagaaatctgagttagccctgtgagaagggttgacagcacaaacagtgcatgaaaatcacagataaccatggtatatctcgcaagtggtcagtgtaaaataaaccaccaccaccaccacaaaaaacacaaaacaagcagaaaaatgcttattcaaaaatctaagacaaaatactgtgtgagaaacaggccacggggttgccttttctcaggccacacagctttcccattccatgtgctcacatggaccgtgagatgtgaaagtctgcagggcgtgtgctcgggatcgaggctggtactgttcacctgtgggtccagaccaaatggcaaagaggcagaaagctataactctgtccaccgccacggcttagggcctccttctcacagaggctccaaagagcccccacctcagccttcacacaaaacatctccttctggctgaacaacagccaggctggagtgccgtggcatgatctctgctcactacaacctccacctcccgggttcaagtgattcagtctcccaagtacacgggattacaggtgcatgccaccatgccaagctaattttttttttcttttttgtatttttattagagacagggatttacgatgttggccagtgtggttttgaactcctgacctcaagtgatccagagtgctaggattacaggtgtgagccacagcttctggcccaggccccattttttaaaaaataatttcaaattttattttagattcatggggtacatgtgcaggtttgttacatgggtatactgtgtgatgctgaggtttggggcacaaatgatctcctcactcaggaactgagcacagtacccaataggtattttttcagccctttccacactccttctctcttccctctagtagttgcagtgtctactcttcccatctttacatccgtttttacccaatgctcagctccgacttatacatgagaacgtgatatttggttttctgttcccatgttaatttgcttaggattatggtctccagctccatccatgttgctgcaaaggacatgatttcattcttttcatggctgcatagtattccatggtgtatatgtaccacattttctttatccagtctaccgctgatggccacctaggttgattccatggctttgctactgtgaatagtgctgtgatggacatgcaagagcatgagtctttttggcagaacaattactttcctttaggtaaatgcccaataaagcaagtgctgggtggaaagatagttctgttttaaattgtttcagaaatctccaaacggttttctacattaatttttccatgaactgatttacactctggccaacagtgtacaagcattccctttccactgcagcctcatgagcatcttctattctgtggacattttaataataaccacactgcagccaagctctttcaagcccaatgtggggaacagccacaaacatcccttttcccaacgagaattcttgcctgcccactggtagaattcttgttttcagctgtctttcattgtttgcttttcaaagaaaaaccaaaggtaaagtggtatgatcttccacacgtgaaccagtttgtagccaccagagcctgctgggaaggggcccctcacgcatgcattgatcttgtcatgtggaatttgagagatctagaagccccacagcaacctaccatacaactgcctatcagcgctcatcctttcacaggattagctcaattctggctctgcagacactggcagccacgggtgagaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaagtgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcacctccagaaagctcatttgatcatctgtaaaatgggcaagcccataggtggttgtgatgacaaaatgaaaaaaactttcttaacttacatgagtgacatgctgtatagtaagttacatgctatataggaagcacacagaaataattcactgttatcataaatgaaacacagtggattagtgagctaagcactaaatggaagccagaaagatgtctagagaagtagacaaagaaatctatagttcagaatgaacagtatcaagaatgacatgtcctccaaattgagcttgggcagctggatctgaacctatcctacacatctgagtctacagtatgaggtaacagcctccacctatagctatcttctctgcctgtaaggtcattcccttttgaagaaagctgacctcagactatactgtgattgtttaaggaagagcgcaaaatactggagaaggctagtcttcaagctctagatacagaaaatccttatattcttgggtgttccctttcagacagagtcagagccacaaccgctaatccaaaaatcccattttccaaaaaaattttccatcttccaccaaggttcccctccctgtttagtgcacactggtgtctacagttgctagagcaagagtctctccttatgctttaagcaggagttctgtgaagaaaccatgccaaggggacaaaacaaaacaacatatttagggacaacacaggaaaaacccatattatcaaaactccaaaacctggctacctcaggcttggccagttatctgtgagcagagagttgtgtcatctacatagctatcatggcccagacggtctggaaatgtggcaaggtaaggctctgagacaaggtgccaggagaaagatgaattcaatcatccatttctgccaggaagaaaagcaccaggaaggaatcagatgtacagtttgtcctctggggacctctgccttgatcctcaataagtctccttttagatgccacctgcagcaattcccacacttcacatgctctccatggcttccattggccttatggtcagctctgccaagatctgtattcttgggcaagacagaatccttctgaatctcactctcttgctctataaatggaaacaattttgctctgcacaaatcacaattagaatatttgtgggaagttaaagtgtgaaacacagcataaatgaaaagcaatgtaccactgctgcttacatgaaaactcctgtaaagctgtcaggcaccatgaaccatctaaatatagcagtgttaggtataagcccatcagtgattagagggggtacggggtggagagggggtctcctagcagtgggcctcctcgctgtggggaagctggctcggccaccatgccaagagctgaacccgaaggtactctgtgtgtcctctcaactccacgggccccactttggcattttctccaattccctctggtttccatttgcttcatccctctagccccctgaccatgtccaatttcaacaccaaatttctgagcttttctcatgttgttcactgtctccagaacatccctgcttcttgtacgtttcaaagaattcacacttgaactctgctcactcctgcccatcaccaacctgagctcagagttcctgagaagggaaagcacccttataaggaagctcctccttttcttacatcattagacttgagcgcagacagcgtctccatctccacactgctctggccaggttgtgcctcagtcaattacacaactgtgtcttagtagccttggtagggcccaaatcaggatattctctgggaagattcactttgtactgagccaagcataatctcactgcatcaaaaatagaaaattctagaccaacccctccacatcttcgttattgaacccaatatgtcacccatttaccatgtgctcaaatctctacctactgctgattctcagatcaaatcgtaacccagatttaccatggtccaaactctgacatctgattggggccatgtcattctggttcaggctgtcagccccaagcaggagggtcagtttgcatcaccccgagtgcaggtttcaaggacaaccctgaggctgcatgaaaagaacctacgacaggttgcatatgagagagacaaatgtcttcacattgaagaagggaaggagtgggccattggttttacatcctccagatgcactgagtaagctcctacctaacctgtgccccctccttctttgaaacacatccccatccttaagccttggtaggaaggagagccatctggaagccctgaatcctatggaatgctgagtctctcttctccttaccccttagtgttggaattcttgttcccctaagacttggatttgaccttcccgctgagtgactggagagaagcatcttcatattcacaggaatgagccttagataaaactttgcacatctcatgggggctgcagaacactgaaaagccaagcttgttaccaatacttgcccttccttaagtatattaaatacaatcccaatagttaaacagattcctaaacagccaggccattctccctccttctaaccctcatctcctgggcctaagaaagcccagctgtgtgatccggggcttggcttcccctgtcctccccatcctagcatccttgcaggaaagagccgctctccctctctgctctcagaaggcaagtttccttatcacctgtgaatcacaaacccagagagtggccaaacatagccgagctgatgcaagaacatgggaagcagaaagctgcaggtgtgtttgtgctgggaggaatggtgaccctcacctcacagacacctcctctctggatcctccagagctataaagacgggccttccaccaccagacaggcgcactctaccaccatgaatccactcctgatccttgcctttgtgggagctgctggtgagtttcatgccctgcctcaggccccaaccaccccccgttactggcagacatatgccctgccgttcttgccacctctcctcttttgactgttctctgatattctgtttcctccatctggcatatctccttcccatcctccttgggctctctttaagcctcacctcttttaccttctccctgatttcattcccaccactgtcattcacccatatttgagctgtagctggagaagctggaaatggagaccaggtggggcaggtccacaaaataaagcagcaggcttcaggcttggctccaacagcaccagaatagcaccactatagctgctcttaaccttggatgcacctggggaggttgaaaaatttctcatgcgagagactcagctctagaaattctaacttcatttctctgggatgcagcctgtgtactggctttttaagcttctcaggtgatttgtaacatttccaggcatgcagccaagattaagaattgctgtcctattggctaataacaatgtctaccattctctgctgaagtgagcctaggggctgccctcaactctgccctgactacacaaatctgagctatgggggaagctggtcatgacgaggtctatgcaactagggggttttcctagcttggccaaagtatcctgataatccagggctcaaataggcagaagaagtacacaggtgatgaataaaaaagagaagcattcagtaggtgagaaaaccacatcccatctcctatcctacaggaagcattttgaggacattccttatgacctcagcctggtgaccccaggagagatctgaaaccccatggggtacctagctacgtgccctggagacacaaagacgtgggagtcacatccagtgatgctcacaggggtggcagagctccctcccttgcctagcctcactgtgcttgttaaggatttctaattagcaggaagcaaacgcaggctgggagtgccacccctaacatgctactgacttgccttctcccttcccatctccactccagttgctgtcccctttgatgatgatgacaagattgttgggggctacacctgtgaggagaattctgtcccctaccaggtgtccttgaattctggctcccacttctgtggtggctccctcatcagcgaacagtgggtggtgtcagcaggtcactgctacaagccgtaagtgtggtgccactgactgcaaagctcccagccaggctgcctcggagagcttggcttcagcccagggaagtactgaggttgggtaagatggatgggagaggtggtggagaaaaaacttgttttcagcagctgactctccagagcagagagtgaacacaagacaggaagctctcacacacaggcaaatccatgaaacagcaagggttgtggtcataaaagcaggcagggatgatcttggggtggtgagagctagtgaaaaaagcaggaaagtacctttagctagttagctacaccttaaagccacctaagaaagagtttttaaaaatactgatgcctgtgtcctatcccagggcaattatcaggaattttcaggaagagggtgtgaatatcaatgagtatttcacactctaccttggtaactgtagagtgtattgacagagctgataaccactgcctacacgaagaaccctcatacctgagtatgcaccaccagaaaaaactgcaggcttgttaaggacaaatcactgggtcccatccccaaggttctgatcagtaggtgggggtaaagaccaagaatttacatttctaacaagttcccaggagatgctaatgctatggctacccttggattagattacacagaagggtggtgctcaccaggccaagaatgcagggaggagcaggcactgtgcacagttagcaaaggcctggggtgaagaatgctgggaaaacttcaaggacctccttgtgcccacaggactagtgactgtaaagattgtgtgaaagaggctgggaaggtgggttgaggagcagcctccagtgggatccctttgactgttccccaccccattaccaccaacctctgaagcagaaaggtcctgggtctcacacctgcactgacccacatccctatcctgcccatgtgatatgaccacgtacccaaccccatgcctccagagctgcccatgagcaggaagcttgaggaccctcgggaaggtgggatgggtgccccagctgtgaaagaagggcttcaccatgcctgccttgcccatcagccacatccaggtgagactgggagagcacaatatcgaagtcctggaggggaatgagcagttcatcaatgcagccaagatcatccgccaccccaaatacaacaggattactctgaacaatgacatcatgctgatcaagctctccacacctgccgtcatcaatgcccatgtgtccacgatctctctgcccactgcccctccagctgctggcaccgagtgccttatctccggctggggcaataccctgagctcagggggtgagtggcaccctttgtccttctacttccctccatcctcacaatttccacaatgaagcatgctccttaacttaaatcctctcacctccaggacacatttctagtgcccattacacacaggttctgcactgggcaccagagagatgcaaagtctcaaggacttggctcctaaaatcaagagacaggacaaatggagaacttggtgccattacttcttgggaggggttcaacaatgatcattctaggaactaaaagccagattcccttgccaggacttgttttggagtcctctccaggggcagtgttcctcttcaatgttccatcctagattactgtctccttctctggcctgacccacatttctactttctttattctcttcctgatcctcacagccgactacccagatgagctgcagtgcctggacgctcctgtgctgacccaggctaagtgtaaagcctcctaccctttaaagattaccagcaagatgttctgtgtgggcttccttgagggaggcaaggattcctgccaggtgattagaccaacccttcccatgctgatgttcccactgatacccaggacccaccagggaaaaagatttgaactcccaaggtggggggctgaggaggctccctgcagtgcccacatggagaagtgaggaaggctcccttgggctgcatcctgtatgcttaggaagaacagagaatgggccaccgtgagaagaacatggagccacagagctggctggaaaggggtcttttaaggttcagagtaactgtagctatattcctcctccatctctccataaaacttgtcccttcttcatgccagggtgactctggtggccctgtggtctgcaatggacagcttcaaggaattgtctcctggggctatggctgtgcccagaagagaaggcctggagtctacaccaaggtctacaactatgtggactggattaaggacaccatagctgccaacagctaaagcccctggtcactctgcagtctctataccaataaaataaccctgttctcactgtctgtgtctgtgcctgctctctcacactccttcacactggaaagcatcctccaatctcagttcagatatgactctcccccttaaaggtaagcagagcccccagctcacaaaatgtgttccattgtacactagattagcgcatacaaacagatggaatccaaaaataagaagcagcttcggagaaaggcagggcactgtttctagagaaacgtgtgtttcagaaaggtagtctttgggggagggtattgatttttatttgggtttctcacagtggttagagctactctgccttcagaacaatcacagcatagaaaatatgtcagcatcgtccaggtggcccaaaaaatctgaccagcggaatcttattgctaaaacacaataatgacaaatgctgttggtgatgtcatgcctctcccaggaatgtgtcagcaccaaaccctcaaccaagccctcccttctcattcacctggaaaatcagattcaagtaaatctccctggcacgctgactcttccctcaattccttagttccatctctgtgagccggctagagagatgttccacctaccatagcgggagccagactgtgacttgggaatcaagcccagctctgcacgctgcactttcatcttctttgcctttggggtaggacaccacagtgaatcccacaattaacaccagctccccagtctgaccagggaaagaaattagagagggtcaggattcacccatttgatcaattaactgaggaaggattcattttcataaattttgcttgcctttaagacacttcaagtgagttatttgggactcattaaaaagggtggaaggaaagacatctgagggctgtgacaccatgcagccactctagccacatgttggctggcttgcacacactggacacagcagagggaggcaggccccgtggtacttgtggcacctgcaaaagcctcctcctggaaattcggagagggcccagcttggtgccgtaactcatccaagcctgtcaccgaagatccaagcaagcttctctttgaaattccactttcaccttctgtcccaagtggttgtggacacccctgggagctggtactaatggccaggagcagccaaggaagacagacaagttcagagcacatttccagttacggggaacagagcacaggcctccaagtgtccatggagcagcgtgcaaattgcagtgatgagtagagtaaaacctctacacggagcacagcattcctggcaaacacaggggaccgctgtccacatgttgtggaatacacccaagtatgcatcagacacttgtttggtaaacagtaaatgtgtaagatcaattgccttgagagggccatccgggctccagaagtgtgattcgtgtgaggaaacagctaccactcactatcttcagaggaaaacagggctcagggctcacacacaatggacagatacaaacaggtcacccagaacgtcactgcatataaacagcactttgttcaacatggattttgtttttatggagtccaaacacagaccgtagttcaccttacagccttgggtttgtctgctttgggagatacatatccagttgatagacaagacagatacatttttttccctttcttaccataatgtcaatgcctcatctgaatatcatcatcactcaagagtcaagggaagaaccaaacacttcatataaacagagctgggctgggtggggagtgttagtttccagtgttttctgtctccattcagatcattcctatcaaagcccagctgattacctcaagccaagacacagacataaggatcccaatggccttccagatagctgcttccacctcctacctgggccacatagagtctttacacaggaaagtgagtcaccccactgagaagggttgccagcagaaacagggcatgaaaatcacagataacaatgggaatccttccaagtggtcagtgtaaaatagatcaccaccaccaccaccaaaaatgcaaaagaagcaaaaaaaatgcttattcaaaatccaagacaaaatactgtgtgagagtcaggccacggggttgccttttctcaggccacacagctttcccagtccatttgctcacatggaaccatgagatgtgaaagtctgcagagcgtatgctcaggatcgaggcttgtactgttcacctatgggtccagaccaaagggcaaagaggcagaaagctgatatctgtccaccgccaaggcttagggcctccttctcacagaggatctgaagagaacccacctcagcattcacacaaaacatcttctggctcaactacagccaggctggagtgccatggcatgatctctgctcactacagtctctgcctcccaggtcaagggattcagcctcccaagtacttgggattacaggtgcatgccaccatacccagctaatttttttttttttgtatttttattagagacagggattcaccgttttggccagactggttttgaacacctgacctcaagtgatccaaagtactgggattacaggcgtgaaccacctcttctgtccgaggccacattttttaaaaaataatttcaaattttattttagattcagggaggacatgtgcaggtttgttacactggtatattgtgtgatgctgaggtttggggcacaaatgatctcatcactcaagcagtgaccatagtacccaataggtagtttttcagcactttccacactccttctctcttccctctaacacttgcagtgtctactgttcccatctttatatccatgtgtacccaatgctcagctgccagtatacatgagaatgtgatatttggttttctgttcctatgttaattcgcttaggattgtggtctccaactccatccatgttgctgtaaaggacatgatttcattcttttcatggctacatagtattcaatggtgtatatgtaccacatttccttcatccagtctaccgctgatggccacctatgttgattccatggctttgctagtgtgaatcagtgctgtgatggacatgcaaaagcatgtgtctttttggcagaacaattattttcctttgggtaaatgcccagtaaagtaagtgctgggtggaaaggtatttctgttttaaattatttcaaaaatctccaaaatgcttcctgcattaatttttccatgaactcatttacactctggccaacagtgtataagcgttccctttcctctgcagcctcaccagcatcttccattttttggacattttaatagccactatgcagccaagctctttcaaggccaatgtggggaagagccacaaaaatcccttttcccaaagagaattattgcctgctccctggtagaattcttgttttcaactgtctttcattgtttgtttttcaaagaaaaaccaaaggtaaagtggtatgatcttccaaacctgaaccagtttgtagccaccagagcctgctgggaaggggctcctcaagcatgcattgatcttgtcacctgcaatttgagagatcaagaagccccatagcaacctacaactgcccatcagtgctcatcctttcaggggattagctcaattctcgctcagtagacactggcatccacaggtgataaaagcccgagcctctgtgggcttctctcatcatccagggccacaatgggctgcctgtcctaggcagagacacagcaactttcccttaaactgaaattaagcataaacccacttcaccaataatcatctgagggcatagtccctgtttccttcctcagggatttaaaacacacatctctctgaccaaacaggtaggtgagatctgactctaaaggggggaaaatcagcatgaattggggtatcaggaatgaatcccaagtgtttttgtgtggggacaggcatccacatcccgaactgtacctggagatggaaaaaaatgcaggagaggagaagagaaagaaagggggaaaaagtggctgaaagtcattgcaagcttctcttgtggttctttctggctctggttgctttgccaaggtcttgagtgcaggcagggctggctctggctgggagctgctgctctgggagatggaagagtcacttcacctccagatagctcattcgatcatctgtaaattgggcaagcccataggtggttgtgatgataaaatggaaaaaaaaatgcttagcttatatgagttacatgctgtatggtaagttacatgctatatagtaagcacacagaaatgattcactgttatcataattgaaggatagtggttcagtgtgctaagcactaaacacaagccagaaagatgtctgagagaagtagacaaagaaacctatagttcagaatgaacagtaccaagaatggcatgtcctccaaattgagcttgggcagctagatctgcacctatcctacacatctgagtctacagtatgaggtaacagtctccacctatagctatcttctctgcctgtaaggtcattcctttagaagaaagctgacctcagactatactgtgatcatttaaggaagagcgcaaaatactggagaaggctagtcttcaagctctagatacagaaaatccttatattcttgggtgttccctctcagacagagagtcagagccacaagcactgacccaaaaatcccttttttcaaaaaaattttccacttctaccaaggttcacctcgctgtttagtgcacactggtgtctacagttgctagagcaagaggctctcatcctctaaggtctgtgaagaccccatgacaaggggacaaaatgaaacaacatgttcagcggcaacacaggaaaaacccatattatcaatgctcaaaaacctggccacctcaggcttagccagttattcgtgagcagagaggtgtgtcatctacatggcagtcatggcctggatgggtctggaactgtggcaaggtaaggctctgagacaagatgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacatttcacaatgctctccatggcttccactggccttatggtcagctctgccaagatctgtattcttgggcaagacagaatccttctgaaactcagtctcttcctctacaaatggaaataattttgctctacacaaatcacaattagcatgtttgtgggaatttaaactgtgaaactcaacataaatgaaaagcaatataccactgttgcttacgtgaaaactcttgtaaagctgtcaggcaccatgcaccatatgagtacagcaatgttaggtataagcccatcagtgattagatgggatacagggtggagagggggtctctgagcagtgcgtctcctggctgtggggaagctggctcagcggctatgccaggagctgaacctgaaggtaatctgtgtgtcttctcaactccacgggtcccactttggtattttttccaattcactctagtttccatttgcttcctccctctagccccctgcacatgtccaatttcaccatttctcattttgttcactgtctccaaggtcggtcagtttcaatcaccctgagtgcaggttgcaagggcaaccgtgaggctgcataaaaagaacctatgacagaatgcacatgagagagacaaatatcttcacattgaagaaggggaggagtgcaccattggttttccatcctccagatgcactgagtaagttcctacctaaccagtgccccctccttctttgaaacacttcccatcctcaagccttggtaggaaggagagccatctggaagcccagaatcctatgggatgctgagtctcccttctccttacccctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 251 - DNA, 37923 bp, Homo sapiens
ctcagtgttggaattcttgttgtccataggcttggatttaaccttccgcacggtgactggagagaagcatcttcatattcacaagaatgagccttagataagaccttcctcctctcatgggggctgcaggtcactgaaaagccaagcttgttaccaatgcttgcccttccttaagtacattaaatgcatccccaatagtaaaatatattcctaaacagccaggccattctccctccttctaaccctcttctcttcggcctaagaaagcccagctgtgtgatctgcggcttgacttcccctgtctttcccatcccagaatccttccaggaaacagccggtctccctctctgctctcagaaggcaagtttccttatcacctgtctgctctcagaaggcaagtttccttatcacctgtgaatcacaaacccacagagtggccaaacatactgatgcaagaccataggaaggggaaagctgcaggtgtgtttgtgctgggaggagtggtgaccctcacctcacagacacctcctctcccgatcctcgggagataaaaagacgggtcctccaccaccagtcaggcacactctaccaccatgaatccactcccgatccttgcctctgtgggagctgctggtaggagtttcatgccctgcctcaggctccaaccataccccgttcctggcagatgcatgccctgccattcttgccacctctcctcttttgactgttctctgatattctatttcctccatctggcatctctccttcccaccctccttgggctgtctttaagcctcacctgtttcagcttctccctgatttcactcccaccactgtcattcatccctatccgagctgtggttggagaagctgggaaaggagaccaggtggggcaggcccacgaaatgaagcagcaggcttcaggcttggctctgacagcaccacaatagcaccactatagctgctcttaacctcgaatgcacctgaggaggctgaaaaattactcatgccagagactcaactctagaaattctcacttcatttgtctgaggtgcagcctctgttctgggcttttaagcttcccaggtgatttttaacatttctaggcatgcagccaaggttaaaaattgctgttgttttggccaataataatgtctacctttgttctgccgaagtgagccttgggctgccctcaactctgctgtcactgcaaagatctgagctaagggggaaactggtcatggccaggttttcctagccagacagggggttttcctagcttggccaaagtatcctgacaatccagggctcaaatcgccaggagaagtacacaggtgatgaataaaagagagaagcattcagtgggtgagacagccacattccaattcctatcccactggaagcattttgaggacattccttatggcctcagcctggtgaccccaggagagatctgaacccccacagggtacctagctacgtgccctgcagacacagagacttgggagccacatccagtgatgctcaccaggggtggcagagctcccccaccttgcctagcctcactgtgcttgttaagttttctaattagcaggaagcaaccgcaggctgggagagccacccctaacatgctactgacttgccttctcccttcccatctccactccagttggtgtctcctttgatgatgatgacaagattgttgggggctacaactgtgaggagaattctgtcccctaccaggtgtccctgaattctggctaccacttctgtgttggctccctcaacagggaatagtgggtggtgtcagcagctcactgctacaagtcataagtgtggggcccctgactgcaaaactcccagccaggctgccggggagagcttggcttcagcccagggaagtactgaggttgggtaagatggatgggaaaggtggtggagaagaaatcttgttggcagcagctgactctccagagcagagaatgaacacaagacaggaacctctcacacccaggcaaatccatgaaacagtaagggttgtggtcataaaagcaggcagggatgatctcggggtggtgagagctagtgagaaaagcaggaaagtacattttgctggttagctacacactaaagccacgtaagaaagcgtttttaaaagtactgttgcctgtgtcctatcccagggcaattatcaggaattttcaggaagagggtgtgaatatcagtgggtatttcacactctacctctggtaactgtagagtgtatagacagagctgagaaccgctgcctacaccaagaactctcaaacctgagtatgcatcagaactccctgcaggcttgttaaggcacaaatcactgggtcctatccccaagtttctgatcagtaggttggggtaaggaccaagaattcacatttctaacaagttcccaggagatgctaatgctatggctacccttggattagattacacagaaaggtggttctcaccaggccaagaagggagggaggaacaggtgctgtgcacagttagcaaaggcctggggtgaagaatgctgggaaaacttcaaggagctccttgtgcccacagtgctagtgagtgtggagattgtgggaaagaggctgggaaggcagattgaggagcagcctctggtgggatccctttgactattccccaccccactaccaccaacctcggaagcagaaaggttctgggtctcacaagtgcactgacccacatccctctcctgcccatgggatatggccacacaccccaccccatgcctcaggagctgtccatgagcagggaggtggagaacccttgggaatgtgggatgggtgtcctggctgtgggagaaggtcttcaccatgcctgccctgcccatcagctgcatccaggtgagactgggagagcacaacatcgaagtcctagaggggaatgaacagttcatctatgcggtcaagatcatccgccaccccaaatacaacagctggactctggacaatgacatcctgctgatcaagctctccacacctgccatcatcaatgcccatgtgtccaccatctctctgcccaccacccctccagctgctggcactgagtgcctcatctctggctggggcaacactctgagttctggcggtgagtgggaccctttgtccttctacttccctccatcctcacaatttccagaacgaagcacaccgcttaatgtgaatcctctcacttctaggcttaagacacatttctagtgcccattacacacaggctctgcactgggcaccagagagatgcaaattctcaaggacttggcttctaaaatcaaaagacaggacaaatggagaacttgctatgatcacatcttgggagaggttcaacaatgatcattctgggaactaaaagccagagtcccttgccaggacttatgttttgaagtcctctccaggggcagtgttcctcttcggtgttctatcctagattattgtctctttctctggcctaacccacatttctttctttgttctcttcctgatcctcacagccgactacccagacgagctgcagtgcctggatgctcctgtgctgagccaggctgagtatgaagcctcctaccctggaaagattaccaacaacgtgttttgtgtgggtttccttgagggaggcaaggattcctgccaggtgatttgaccccttcccatgctgaggcttccactgatacccaggcttcatctgggaaaaacatttgaactcccaagttggtggggctgagtctccctgcattgccccatggagaagtgaggaaggctcccttgggctgcaagctgtctgcttaggaagaacagagaatgggccactgtgagaaggatgtggagccacagagctggctggaaaggggtcttttaaggttcagagtaaatgtagctatattcctcctccatctctctcttcatacaacttgttccttcttctccccagggtgactctggtggcccagtggtctgcaatagacagctccaaggaattgtctcctggggctatggctggcccagaaaaacaggcctggagtctacaccaaggtctacaactatgtggactggattaaggacaccatagctgccaacagctaaagtccccagtccctctgcagtctctataccaataaagtgaccctggtctcactgtctgtgtctgtgcctgctccttcacactcctttacactggaaagcatcctccaatctcaggtcagacagggctgtcccccttaagggtcagcagagcccccagctcccaaaatgtgtcccatggtacactagattagcacatacaaacagatggaatccaaaaataaaaagaaatatcggagaaaggcgggcactgttttctagagaaacgtgtgtttcagaaaggtggtctttggcaggggatattgatttttatttgggcttctcagagcagttagagctactctaccttcagaacaatcacagcacagatattgtgtcagcatctttgaggtagcacaaaaaatctgaccagctgaatcttcttgctaaaatacaacaatgacaagtgctgttggtgatgtcatgactctcccaggaatgtgtcagcaccaaaccctcgaacaagccctcccttctcattcacctggaaaatcagactcaaataaatctccctggcccccaaactcttccctcaattccctagttccatctctgtgagcaggctagagagatgttccacctaccatagcgggagccagactgtgacttggaaatcaagcccagatttgcacgctgcattttcatcttttttgcctttggggtaggacaccacagtgaatcccacagctaacaccagcccccaatctgaccagggaaagaaactagagaggatcaggattcacccatttgatcaattagctgaggaaggattcattttcataaaacttgcttgcctttgagacacttcaaatgagttatttgggacactttaaaaaaggtggaaagaaagatctgagggctgtgacaccatgcagcaactctggccacacattggctgacttgcacccactggacacagcagagagaggcaggcttcatgtcacctgtgtcacctgccaaagcctcctcctggcaattctgagtgggaccatgttggggccgtagctcatacaactttgtcactgaagatccaagaaatcttctctttgaaattccaccttcaccttctgtcccaagtggttgtggacatccctgacagccagtaacaagggccaggagcagccaagggagacagacaagttcagagcacatttccagttacacggaacagagcacaggcctccaagtgtccacagagcagcgtgcaaattgcagggatgagtagagtaaaacctctacatggagcacagcattcctggaaaacacaggggactgcggtccacatgctgtggaatacacccaagtatgcatcagacacttgtttggtaaacagtaaatgtgtaagatcaattaccttaagagggccatctttgctccagatgtgtggttcgtgtgaagagacagctaccaatcactatcttcagaggaaaacagggctcagggctcacacacaatggatagatacacatgggtcacccaaaacttcgctgcatacaaacatcactttgttcaacatggattttgtttttatggagtccaaacgcagaccctagttcaccttacagccttgggtttgtctgcttttggagacatatattcaatagatagatagatagacaagacagatacattttttccctttcttactataatgtcaatgccttgtctgattatcatcatcactcaagagtcaagggaagaacaaaacacttcatataaacagggctgggcttggtggggagtgttagtttccagtgttttctgtctccattcagattattcctatcaaagtgcagcagctggttacctcaagccaagagacagacataaggatccctatggccttgcagacagctgcttccacctcctacctgggccccttagactctttacacaggaaagtgagtcaccccactgagaagcgttgccagcagaaacagggcatgaaaatcacagataaccatgggattacttccaagtggtcagtataaaatataccaatactaccaccaccaaaaacacaaaacaagcaaaaaaaaatgcttattcaaaaatccaagacaaagtactgtgtgagagccaggccatggggttgccttttctcagtccacacagctttcccagtccatttgctcacatggaaccatgagatgtgaaagtctgcagagggtgtgctcaggatggaggctggtactgtttatctgtgggtccagaccaaagggcaaagaggcagaaagctacaactctgtccactgccgcggcttagggcctccttctcacagaggctccgaagagcccccacctcagccttcacacaaaacatcaccttctggctgaactacagccaggctggagtgcggtggcatgatctctgctcactacaacctccacctcctgggttcaagtgattcagactcccaagtacctgggattacaggcacctgccaccatgccaagctaatttttttttttttttttttttgtatttttagtagagacaggctttcaccatgttggccaggctggttttgaactcctgatctcaagtgatccaaagtgttgagattacaggcatgagccactactcctggcccaggctccactctaaaaaaaaaaataatttcaagttttattttagattcttggctgcatagtattccatggtgtatatgtaccacatttcctttatccagtctaccgctgatggccacctaggttcattccatggctttgctactgtgaatagtgctgtgacggacatgcaagagcatgtgtctttttggcagaacagttattttccttcaggtaaatgcccaataaagaattgctgggtggaaaggtagttctgtttcaaattatttcagaaatctccaaactgctttctgcattaatttttccatgaactcatttacactctgaccaacagtgtataagcattccctttcctctgcagcctcaccagcatcttctgctttttgacattttaataatagccactctgcagccaagctctttcaaggccaacgtggggaacagccacaaacatcccttttcccgaagagagttcttgcctgcccactggtagatttcttgtttccatctgtctttcattgtttgtttttcaaagaaaaaccaaaggtaaagtggtatgatcttccacacctgaaccagtttgtagccaccagagcctgctgggaagggatccctcaaggatgcattgatcttgtcacctggaatttgagagatcaagaagccccatagcaacctaccatacaactgcccatcagcgctcatcctttcacaggattagctcaattctgactctgcagacactggcagccacaggtgacaaaccctgggcctctgtgggcttccttcatcacccagggccacagtgggctgcctgtcctaggcagagacacagcaacattctcttaagctgaaattaagcataaacccacttcaccaataatcatctgagggcacagtccctgcctccttccttggggattttaaaacacacatctctctgaccaaacaggtaggtgagatctgactttaaaggggggaaattgggatgaattggggtatcaggaatgaatcccaagtgtttttgtgtggcgaatggcatccacatcccaaaatatacttggagatggggaaaaaagcaggagaggagaagggtaaaaaaggaggacaaagtgtctgaaagtcattgaaagcttctctcatggttctttctggctctggttgctttgccaaggtcttgagtgcaggcagggctggctctggctgggagctgctgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatga

SEQ ID NO: 252 - DNA, 14119 bp, Homo sapiens
ttgttacataacccaggcaagttttagtattttgactgtaagcaattctttaatgtatcatgtagctgtcattactggtgtaaaccatgatgcgtgattctcttaaaaaggcattttcatcaggaatgactgacaaattttcttgctgtcaggggataagcaaataggatgccttttttttttttatcttgttaatgtcactctccatataaatttttactttattttctactttaaatttgtctgcaattttagattcagacatttagggcaatatactagaatttacgtgttgtgcctgaattaaattaggtaattagtatgcaggcaggcaaaaaggaattataaaattttcaaccacttttgtcagcctatatctaaataataacatagtttatttcccaaatatttgttttatatatgaggctctaaccatattctgctaaatatatgtataatttagcaatgtaaggtattatttgcttctatatttggattagttttattttgttcaaaaatagcaaacatttaaaacaaaaaattgtcagtagtttcttttaaaagcttatccattaaaggtttctcattagcatctcctgtttatgattgtatttccttttctctgaaattttattgccatacaatagatatcagtaatttaaaatgcctgccttccgggaatgcacagttacagtcaaacattgcagttatctagacaaattatttgttaatgtacattgatgttgccaactagattttatgagtaaacatttattattgtcttgtagttctatattgtggttttttactataaatttcttaatatcagtttattgtgtttttggttttacttatgtattataattttagataattggcaattctgtttgtatactttaagttaatgtggggtttaattaaaagataaatgggccatatgtctatcacaatcagatatgtgtgtgtttatatctgcaaatgtgaccccaatttttgttgtagcttaccttgtatatattctttcttagctcattctctttttctctttttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggcctggcaaattttgtatttttctttattagagacggggtttctccatgttggttaggctggtctcggattcctgacctcaggtgatctgcccacctcagcatctcaaagtgctgggattgcaggcattagccactgggcccgacctcttagctcattttcaatgttggttttatcttgtctaagtgagtagccttggaaatagtctcattttcgtcatgtgtttaatgatgaatatgtatttcctttgtgtgagacaaacactttgtgatttggaggtaatttttaaaaagatttataatttggtatttttttcagttttttaaaaagtaactgtaaaaacatgtaacatgtaatttagtttcttaaatctatttaaatatacatgtcacagccaggcatagtggtggctcacatctgtaaaaccaggattttgagaggccaggacagaaggattgcttgagcccaaaagattgagaccagcctgggcaaaatgtggagacaccctctctacaaacattttttttctaagaaatagccaggcagggttgtgtgtacctgtggtctcagctacttgagagaatgaggggcagggttacttgagcctgggactgtgaggctgcagtgagccataattgtgccacgcactcaagcttgggtgacagattgagaccctgtctcaaaaaaaaaaaaaaaaagttgtgtatttcaggtatgttaactatattcacattgttatgcaaaagacttctagaaattttatatcttgtaaaactaagactcaatatccattaaataacatttactcattttatgctctctccatcccttaacaaacacccttccactttctgtttttatgagtgtgactattttatatatcttacgtaagtgaaatcataatatctatgattttactactggctgatttcagttgacataatattttcaaagtgtatctttaaatgtgtcaagatttttaagattttttttaaggctgaataatattccattgtatcaaatatgtcttgaaggtcctatattgcatattttagatatagattaataaatggaattgctgtatttgataataattttatttttaattataagaagtacatttataacataaaataatggatgcctgcttgttttctactgacaatcaacacgggtttcttttttttttgagacagagtctcactctgttgcccaggctggagtgcagtggcatgatctcagctcactgcaacctctgcctcccaggttcaagcgattctcctgcctcagcctcctgagtagctgggattacaggcacgtgccaccacacccggctaatttttgtatttttagtagagatggggtttcaccatgttagtcaatctggtctggaactcctgaccttgtgatctgctcacctcggcctcccaacatgctgggattacaggcgtgagccaccgtgccagccagtccaacatgatgaaaccccatctctactaaaaatataaaaattggccaggcattgtggcaggcgcctgtaatcccagcttcttgggaagatgaggcaggagaattggttgaacctggaaggcggaggttgcagcaagctgagaccatgccactgcattccagcctgggcaacagagcaagactccatttcaaaataaaaaaaaaaaaaagaagttatcttctatgtctaattaaaagatttttcacttatggtttcaggaaataatcgaacttaattttatcagtattgatattcagtatggataattcagtatggatattcagttttaaaattatcttttttctattgtgtgctcatgtcaattttgtgggagattatttggccatattcagaagggttatttctgggctctctgttctttcatctgtttatctgtctttttgtcagtaccacattgtgtttgttattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgtctaccactgtaagttgtattgacatctttgaaaaactattattttttgattcctgagcaaacatatgttgaagagtgtgttttattttcttatatttttggattttttttagttttaatttatagcttaattcagttttggtcagaaaacacagtgtataattttggtcttcttaaatatatttgttgttgttgttgtgtttgttgtttttgtttggagacaggatcttactctgtcaaccaggctggagtgtactgccatgattttgcctcactgcagcctcaacctaccaggttcaagtgatctttcctcctcagtgtctcatgtagttgggactacaaacataaagtaccatgtctgaataattctttgattatttgtagggatagagtctcactatgttgcccaggctggcctcaaacttttaactccaagtgatcctcctaccttgatctctaagtgttgggattataggcgtgagctacaccacccagctggcattcttaaatttaataaaacttagtatgtgtcctaacagaatacaccagatgcaaataagaatattgtatattctcttgcttttgactggaaagttttgtactcatgtgttaaacctagttggtctgtaacatggttttgatgttcatgttctccaaaccttattctgcagtgtaatccttaatgttggatgtgagacctggtgggaggtgtttgggtcatgggagcaaagtcttcataaatagctggtaatcaaaatgtttacactccattaattcaaatgtaagcaggtttattagaagaacctggctccttcacctcatacttgctctgtctgttattatgtgacatgtacagttactcttcgccttcaaccatgattgtaagcttgctgagacactcaccagaagcagatgctggcacacactttttgtacagtctgctggattgtgagccatataatctttatttctttataaattatccactcaggtactcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaattgtagttactattttcataaaatgtagttgttttttttttcgctctgtggttttcagcctatttgacttagtgctgaaatgattcccttgtaggcaacatactgtttgcttttttcttaagctagtaaagcattttattttttctttttataatttcatttatttacttgtttattcatttatttttgagatagggtctcactctgtcaaccaggctagtttgcagtgttgtgatcatggctcactgcagcctcaacttacaaactcagaagattctctcatttcagcctcttaggtagctgggttacaagtgtgtagcatcacgcctagccagttttttgtgtatttttggttgagacagagttttgccacactgtcaaggctgttctcaatcttctgagatccagtgatcagcccgccttaacctcccaaagtcctgagattacatttctttttattaagtaatttaatttatatttaaaactgcttcttaaaaatgaagttattggttttattgtaactgttttatgtgttcctgagtggtatgttttttcttattcactgttttattgccttaaattttattttaattgtgtagtgatgtgcttcaattatttttctaattttgttttgcacagtttctttaattattatctttataatcatgttgtctattcatgtgttttcatgctgctgataaaaacgtaccttaccctgggcaaattacagaagaaagaagtttattggacttacagtttcatgtgattgaagagacctcacaatcatggtggaaggtgaaaggcatgtctcacatggtggcagacagagagcttgtgcagaaaaactctgccttataaagccatcagatttcatgagacttattcactatcatgagactagtacagaagagacctgcccccatgattcaattaccttccaccacatccctcccacaacatgtgggaattaaagatgagacttgggttgggacacagccaaaccatattattttaaaaaatggagtttacattaaatatcttaaaattcaaacaatatactttaatgacaacttcaattgaatataaaattatacctctatgtttttcagtttgttattaacattaaaaatttttagactgggtgcagtggctcacgcctgtaatcccaacactttgggaggccgaggtgggcggataacctgaggtcaggagtttgaaaccagcctgaccaacatggagaaaccctgtctctactaaataatacaaaattagccaggcatggtggtgcatgcctgtaatcccagctactcgggaggctgaggcaggagaattgcctgaacccgggagggagaggttgcagtgagccaagattgtgccattgcactccagcctgggcaacaagtgcgatactccatctcaaaataaaataaataaatataaattattttgtgtatttattaacatatttatgcagattgtattctgttttaaatattttacagaggagctttaagggttttatgcatcattattatgatagtaaagacttctatatttgtatatttacatttaatatagacttttattttatatgtggttttgttagagaaaataggaggcaggagacacccagtaggtgaaactggaggattttattaaggtgcaccctggcacaatggattcgcatccaaaaagctgagccttggactaagacagggcttgtcttttatacatgcatgggccatctagtggcgcaaagctcgtggtgcaagtaagcaggctcacagaagcagaacagaggcagttaatcaaacagtgacaggttatgctgaccttgcagcttcactggaagggaaacatgaatttatcaaactaaagcaggccttgcagctggtacatgtcttactcaagctcgtcttgtaaccttgtcatgttatccagaacagagaaactggagttgttgtgaagtaaccttgagtttcactaaggaaggattactaaggggaggaggaagctaggagaggaggaaaaattgtttttcccatcattgctctatgggaggagaggggataaggactagttttctttacatcctctacttcatttccccctttgacgctttttataaatgacgtttaatagcatcactatgacttaatttttcatgaaaaggcaagttttcttcatttggcaaaggctgatatttagttagggtcattagttgtgtagtagtttgcctggttacaagagcctctgtggccatttagatgtttttgacaaggaggggtaagagacaagggagtatgaggcagactcctaatatggctagaactattcttactaaggttttaaattctgcaagggatgagaactaacccctgaagagggaatctggagaccatcctttctaagtcttgactggaatatgggctaatttttggattcttgcagctttttgtttgacgacctttccgttgtcatcgatttttagacagcaattagttaggctgaactttctacatactcctccctcttgggctaggaggtagtctaaagccagtctattttgataaacggcatttctcatttctgtagatttccgagccagcaaatttaaggctcttgcagtatcattcgtaatgatctccagtactgcctgcaaccatatgatgtgatttagcatgtaaataggggtgcggtatctccatgatccatctgcccatgtggctgggccatagtattgcattattctttcaggtggccattcattatctttaattctttatggttattccccttttatttcttttgacctgacatgaacctccaactaggttctaggtaaggactttgggtcataacatatataaggctggccacttcctgggttgcagattgagtaggttatctggttgtgcgtacaagttcctcaatgggtccctgcatacctataataagtggtagaacagggttctagtcatggtgcttcctgtctacgtattgtcagtgcagtgggggcatccttctaaggattctccctttaacgtggttaaagggaatagcaaaagtaatgaataacatgtttatacctagcatggagagaagaggtcctttcctagaggaggaggttgagcaaagcaacaggacaatagtaaaacaattaatattacaaggaaagtttccagacgtaagatttctaaccacttttactttcctgatgatgcctcgagctttggccgtacatagacgagtcagcttctggggtgactagaacagggctgttgtttcctcaagcttccaccgtgtgtagactggtcagcttctgaagtgaccagagcagggctgttgtagtcttcattggcacctcggtcccatcataggatcagctgggttggatggcctgggtccttctggctggtccacttgtcctgggctaccagtttcagccaactgtggtgaatccaaggcacgattcctgcaactttagcagcagtgagtagacaagattacaatatggggcccatcccatatgggtcccagtgttgttggattccattttttaaactaaacagagtccccgggtctaaagggataaattgggtctgtgaggcttatgggcattctttcccatacccagccatgaattttttgcatggctattcttaaagcctgcatctctctccttaaggctaattcctctagttcacagagatcacctttaaattggccgaacaagatctcataggtgaatacccagtttgtttggtgggggtgtacctcacttggaggaggaccatgggcaggacctgatcccaccttagatgagtttcttggcaaaatttttttagtagctgtttgagtgtctggttcatgtgttccactttttctgagctctgtggccagtaggctatgtgtaacttccactttattttcaataactgtgttagttcttgaactatcttggctatgaatgctggtccattgtctgacgctagagtcaggggcagtcgaaatccagggataatgtctcttaacagtactttagttacttctcgtgctttctcagtcctgatggggaaagccttgacccatcctgaaaaggtgcagacaagtactaacatgtttcaatatccccctgcttggggcaacccataagcagattttcacaaggtgtggcccctatttcctgcattcccagggtcctggtgggcccctgtattaggttgttctgggcacaagttaggcattgttcacaaatggctcatgtgatggcagtgagccgtggcacatagaagtggtgtcctaatagcgtctctagtgccgtttttcccatgtgagttccttggtggaattgcctcacaaatttggaggccaccatttcagggatggctagtctcacattagataatttccaccatcctccttcaatatgttctccagattcttgggcaaaccaggccctgtcacttagagagtaactccgggtctcctggaggggagattgcgggaggagaggcatggtcagggcttcttttctagagtgtggagcagtcaatgctgtctgtcttgcttctctgtctgcttttccatttcccttggcctcctgtgtccctgacttctggtgtcctttatagtgcataacagctaccttctctggggctcatacagcatctaagagctgtataatttcttctttgtatttatttctttgcccctggcagttaaaactcctccttatatatagcaatgtggcaaaagcatatttggaatcagtataaatattgatctttttgtcctttgctagcaaaagggctcttgttagagctatcagctctgctttttgggctgaagtttctgtgggcagagactgagcttccaccaccaagtgcaatgttactactgcatacccggcccattggactccttccagtacaaaactgcttctatctgtaaagtactcgatatctgggtccctgaggggttggtctgtaagatctctccagcttgagaatacctcatcaactgtgtctatacagcaatgaagagggcctcctggttctgattgaattgggagcaaaatagctgggtttagagtgttcacagtctctagagttacgtgaggatttttacatagaagcccttgataccaactcattattggatttgataaccaatggtgccctctctgatcgactaatgttataactcagtgcgatactcaggtggttagttgctgtcctagagttagtttgtcagcttcccatgccagtagggctgtggcagctaatgctttgaagcatgggggccatcccagcgccatggagtccaactgcctggataagtatgccaccaggcgatgccatgatcccgtgacctgagttaggactcctatagccattccctttcactcatgggcctatagaaagaaaggcttagttagacctggcagtcctaaggctggagccctagttaaggcttctttgatttgtttaaatgccttttcctggtctgcctcccagaggagggacttcttccctgcctcccccacttctaatgtgaccatgggctcctgggggcctagggagaaggaacccggttggtcctagtcctcatattcttaattctctgccagcccgatcaggtcggcatctggctccctcagggtgtggcagcccttggctgggggcctctttgtttcatagcctttgccattctcttcattgtcctctggacattcatttttctagtgtcccttctttttgcactgcacacattgacctccccttagcctcagccatctcttggctcgctgttcaacttggcctcttccatgcccacacccatgtgaacattcgcgtccctttacaatgttaattttcctttttgtgagggctgccgctaacaggttggcctttttcctaagcctctgctctgtttccttttttgcctcttggtcacagttaatgtacacctcggtggccacttctataagctgggtggcattcatgcctgcaaaaccctctagcttttgcagcttctctctgatgtcaccctgggcttgccttacaaatgctgcattcaccatgcactgattttcagcagcctcagggtcaaatggagtgtaaaactaaaatgcctcacagagtctctcataaaactggctagggctcccatcaattcgctggagtacttcagagaccttccttatattgattgccttttttccaccttccctcaatcattgcagctgtgcttcttagtacctttgcaggcgctgaagctgggttgcgtcatttgggtcccagttgggatctgtttctgggaattggccctgagcatatgcctggacattaagggtgccttcaggcacactggcttctagccagcagagagctgcctgggctatcctttgacactccttcgtgttaaacagcgttaggaggagattcctgcaatctggccaggttggattgtgcattaggaagatagactgcattagatctatgaggtcctgggggttctccgtgtaggagggggtatgatgtttccagtttaggagattagtggtagaaaaaggctggtaaataaaagtctgttgccccccttggacctggccctgttcatcataataaataggtccctgtgttttctggaggggcatctgcaaagctctggtgtgggcaaattgaaggtggcctgcttgatcatcttgacttccttcttcacctcctgggacaggggctcagatttgcccctttagggtgtagcctggggcatgataccatctgagttgggctgctcagtggccagccttggtaaaggtgggtagattggtgcatagggagggggggtttctatctcctccggtggttcctccaaaactggtttctcctgtctttcctgtggctttccctttgtctctgtagcttccagcaaagctgatttttttttggtggcttaggctcagcttgagcaaaaagctgccaggcaagtctgcaaccatgcaggtcgagtctgtactatatttaaccatgagtcaatacaagggaactggtctaggtgccctgactgtcctctgaccccagttaccaccttaaatacatagccaattgtttccttatctacatttccttcagctggccatctaacatcaaaagagggccattgtatttcacagagagttctcagcctctgggggtcaacttaattccatagtccccgaataacctttcttaaagttccttaacatacatgctaatcgggtgggttttggtgacttccctcccatttcctccccaatacagcacaacacattcattcttccttttgattcagaccaattaaaccatcccccttgcaggagttttcagacactgcttagctttggagtttgttaatcccctcacaattactaaattgtggggcacctccataagccgtatgtggattgccactagtcctggttggtcccacaattctctcagagcgcacagtctatactaagagacctgtagcccccacatgtcactgtctgcattggttcctcccaaaaccatctctttcacacacagtcacacaccgtcctactcccagttttctctcctaactgacttcgcgagccactcttatgccctagtcacttggggtgtaagtttccctgagtttgcaaaccattcttgcatcctgtgtcagtctactagttacaccttggaaggtgatcaggctccccttccatccttatgggacggttcctgccttgggccccaaaaccttaccgtggtcctgtagtgcactgttcctggaatcatcctgtagccccttagattctgttgtgctgtctgggaggggcattgggttgtgggatagctgatcccttcttcaggtttaagttctcctgagggcacctgaggtcatgggtctctcctggcttggggtctcacacctaaaggcaaagtagacagcaaacctgtcatctccatctcctggctggctcaccaaagtgttgcagaaaacaggaggcaggagaggccagtgggtgaaactagaggattttattaaggtgcacactggctcagtggattcacacacaaaaagctgagccctggacaagtacagggcttgtcttttatatgtgcatggtggccatctagtggcacaaggctcctggtgcaagcaagcaggctcacagaagcagaacaaaggcagttaattaaacagtgacaggttatgctgaccttgcagctgcattgggaggaaaacaggaagttaacaaactaaagctgaccttgcagctgcattgggaggaaaacaggaagttaacaaactaaagcaggccttgcagctggtatacgtcttactcaagctcgtcttgtgaccttgtcatgttgcccagaacagagaaactggagttgttgtgaagtaaccttgagtttcactaaggaaaaattactaaagagacagggaagctgggagaggaggaaaacttgtttttcacatccttgctctttgggagaagaggggctaaggactagttttctctacatcctctacttcagttttatgatggtgttcattattattttatttttaagcaaaattgactcattatagcatttctttttttttttttttttttgcagagtctcagaatgctcttaaactcttagtctctagtgttctgacagccttgacctcctaaaactaagattacaggcatgagccatggtgcctggtcaccatgtacctttttttgtagaactgtgctagtggtgatgaacatcttcaccttttattttggaaattctttattttcatcttctttttaaagggaagtaaatttaaatcaagtattattggttagaaatttttttttattacatcaaaatttgggaagttttcacccttttttatcttcaaataacctctgtattttttttcttcattttcttcttctaagatttcctaaatctagttgatggttatctaataagttgtttgttttgttttgtttttgtttttgtttttgttttttttgagatggagtctcgctctgtttcccaggctggagtgcagtggcacaatctcagctcatggcaaactctgtctcctgggttcatgccattctcttgcctcagcatcctgagtagctgggagtacaggtgcccgccaccacgcccagctatttttttatatttttgtagagactgggtttcaccatgttagccaggatgggcttgatctcctgacctcatgatctgcctgccttggcctcccaaggtatctaataagttttacattccatgttttaactttgttttgcaattatagatttttgtgttatatattttagggtatgccaccacacattcattaattgtgttttgattttttagtatttattataattatgcatgctaatttttaacatcttataatttaaggcagtgtggaagaaagtcaaatatgaatgagctatacgtctttttccaatagaattat

SEQ ID NO: 253 - DNA, 13657 bp, Homo sapiens
gcaatgtaaggtattatttgcttctatatttggattagttttattttgttcaaaaatagcaaacatttaaaacaaaaaattgtcagtagtttcttttaaaagcttatccattaaaggtttctcattagcatctcctgtttatgattgtatttccttttctctgaaattttattgccatacaatagatatcagtaatttaaaatgcctgccttccgggaatgcacagttacagtcaaacattgcagttatctagacaaattatttgttaatgtacattgatgttgccaactagattttatgagtaaacatttattattgtcttgtagttctatattgtggttttttactataaatttcttaatatcagtttattgtgtttttggttttacttatgtattataattttagataattggcaattctgtttgtatactttaagttaatgtggggtttaattaaaagataaatgggccatatgtctatcacaatcagatatgtgtgtgtttatatctgcaaatgtgaccccaatttttgttgtagcttaccttgtatatattctttcttagctcattctctttttctctttttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggcctggcaaattttgtatttttctttattagagacggggtttctccatgttggttaggctggtctcggattcctgacctcaggtgatctgcccacctcagcatctcaaagtgctgggattgcaggcattagccactgggcccgacctcttagctcattttcaatgttggttttatcttgtctaagtgagtagccttggaaatagtctcattttcgtcatgtgtttaatgatgaatatgtatttcctttgtgtgagacaaacactttgtgatttggaggtaatttttaaaaagatttataatttggtatttttttcagttttttaaaaagtaactgtaaaaacatgtaacatgtaatttagtttcttaaatctatttaaatatacatgtcacagccaggcatagtggtggctcacatctgtaaaaccaggattttgagaggccaggacagaaggattgcttgagcccaaaagattgagaccagcctgggcaaaatgtggagacaccctctctacaaacattttttttctaagaaatagccaggcagggttgtgtgtacctgtggtctcagctacttgagagaatgaggggcagggttacttgagcctgggactgtgaggctgcagtgagccataattgtgccacgcactcaagcttgggtgacagattgagaccctgtctcaaaaaaaaaaaaaaaaagttgtgtatttcaggtatgttaactatattcacattgttatgcaaaagacttctagaaattttatatcttgtaaaactaagactcaatatccattaaataacatttactcattttatgctctctccatcccttaacaaacacccttccactttctgtttttatgagtgtgactattttatatatcttacgtaagtgaaatcataatatctatgattttactactggctgatttcagttgacataatattttcaaagtgtatctttaaatgtgtcaagatttttaagattttttttaaggctgaataatattccattgtatcaaatatgtcttgaaggtcctatattgcatattttagatatagattaataaatggaattgctgtatttgataataattttatttttaattataagaagtacatttataacataaaataatggatgcctgcttgttttctactgacaatcaacacgggtttcttttttttttgagacagagtctcactctgttgcccaggctggagtgcagtggcatgatctcagctcactgcaacctctgcctcccaggttcaagcgattctcctgcctcagcctcctgagtagctgggattacaggcacgtgccaccacacccggctaatttttgtatttttagtagagatggggtttcaccatgttagtcaatctggtctggaactcctgaccttgtgatctgctcacctcggcctcccaacatgctgggattacaggcgtgagccaccgtgccagccagtccaacatgatgaaaccccatctctactaaaaatataaaaattggccaggcattgtggcaggcgcctgtaatcccagcttcttgggaagatgaggcaggagaattggttgaacctggaaggcggaggttgcagcaagctgagaccatgccactgcattccagcctgggcaacagagcaagactccatttcaaaataaaaaaaaaaaaaagaagttatcttctatgtctaattaaaagatttttcacttatggtttcaggaaataatcgaacttaattttatcagtattgatattcagtatggataattcagtatggatattcagttttaaaattatcttttttctattgtgtgctcatgtcaattttgtgggagattatttggccatattcagaagggttatttctgggctctctgttctttcatctgtttatctgtctttttgtcagtaccacattgtgtttgttattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgtctaccactgtaagttgtattgacatctttgaaaaactattattttttgattcctgagcaaacatatgttgaagagtgtgttttattttcttatatttttggattttttttagttttaatttatagcttaattcagttttggtcagaaaacacagtgtataattttggtcttcttaaatatatttgttgttgttgttgtgtttgttgtttttgtttggagacaggatcttactctgtcaaccaggctggagtgtactgccatgattttgcctcactgcagcctcaacctaccaggttcaagtgatctttcctcctcagtgtctcatgtagttgggactacaaacataaagtaccatgtctgaataattctttgattatttgtagggatagagtctcactatgttgcccaggctggcctcaaacttttaactccaagtgatcctcctaccttgatctctaagtgttgggattataggcgtgagctacaccacccagctggcattcttaaatttaataaaacttagtatgtgtcctaacagaatacaccagatgcaaataagaatattgtatattctcttgcttttgactggaaagttttgtactcatgtgttaaacctagttggtctgtaacatggttttgatgttcatgttctccaaaccttattctgcagtgtaatccttaatgttggatgtgagacctggtgggaggtgtttgggtcatgggagcaaagtcttcataaatagctggtaatcaaaatgtttacactccattaattcaaatgtaagcaggtttattagaagaacctggctccttcacctcatacttgctctgtctgttattatgtgacatgtacagttactcttcgccttcaaccatgattgtaagcttgctgagacactcaccagaagcagatgctggcacacactttttgtacagtctgctggattgtgagccatataatctttatttctttataaattatccactcaggtactcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaattgtagttactattttcataaaatgtagttgttttttttttcgctctgtggttttcagcctatttgacttagtgctgaaatgattcccttgtaggcaacatactgtttgcttttttcttaagctagtaaagcattttattttttctttttataatttcatttatttacttgtttattcatttatttttgagatagggtctcactctgtcaaccaggctagtttgcagtgttgtgatcatggctcactgcagcctcaacttacaaactcagaagattctctcatttcagcctcttaggtagctgggttacaagtgtgtagcatcacgcctagccagttttttgtgtatttttggttgagacagagttttgccacactgtcaaggctgttctcaatcttctgagatccagtgatcagcccgccttaacctcccaaagtcctgagattacatttctttttattaagtaatttaatttatatttaaaactgcttcttaaaaatgaagttattggttttattgtaactgttttatgtgttcctgagtggtatgttttttcttattcactgttttattgccttaaattttattttaattgtgtagtgatgtgcttcaattatttttctaattttgttttgcacagtttctttaattattatctttataatcatgttgtctattcatgtgttttcatgctgctgataaaaacgtaccttaccctgggcaaattacagaagaaagaagtttattggacttacagtttcatgtgattgaagagacctcacaatcatggtggaaggtgaaaggcatgtctcacatggtggcagacagagagcttgtgcagaaaaactctgccttataaagccatcagatttcatgagacttattcactatcatgagactagtacagaagagacctgcccccatgattcaattaccttccaccacatccctcccacaacatgtgggaattaaagatgagacttgggttgggacacagccaaaccatattattttaaaaaatggagtttacattaaatatcttaaaattcaaacaatatactttaatgacaacttcaattgaatataaaattatacctctatgtttttcagtttgttattaacattaaaaatttttagactgggtgcagtggctcacgcctgtaatcccaacactttgggaggccgaggtgggcggataacctgaggtcaggagtttgaaaccagcctgaccaacatggagaaaccctgtctctactaaataatacaaaattagccaggcatggtggtgcatgcctgtaatcccagctactcgggaggctgaggcaggagaattgcctgaacccgggagggagaggttgcagtgagccaagattgtgccattgcactccagcctgggcaacaagtgcgatactccatctcaaaataaaataaataaatataaattattttgtgtatttattaacatatttatgcagattgtattctgttttaaatattttacagaggagctttaagggttttatgcatcattattatgatagtaaagacttctatatttgtatatttacatttaatatagacttttattttatatgtggttttgttagagaaaataggaggcaggagacacccagtaggtgaaactggaggattttattaaggtgcaccctggcacaatggattcgcatccaaaaagctgagccttggactaagacagggcttgtcttttatacatgcatgggccatctagtggcgcaaagctcgtggtgcaagtaagcaggctcacagaagcagaacagaggcagttaatcaaacagtgacaggttatgctgaccttgcagcttcactggaagggaaacatgaatttatcaaactaaagcaggccttgcagctggtacatgtcttactcaagctcgtcttgtaaccttgtcatgttatccagaacagagaaactggagttgttgtgaagtaaccttgagtttcactaaggaaggattactaaggggaggaggaagctaggagaggaggaaaaattgtttttcccatcattgctctatgggaggagaggggataaggactagttttctttacatcctctacttcatttccccctttgacgctttttataaatgacgtttaatagcatcactatgacttaatttttcatgaaaaggcaagttttcttcatttggcaaaggctgatatttagttagggtcattagttgtgtagtagtttgcctggttacaagagcctctgtggccatttagatgtttttgacaaggaggggtaagagacaagggagtatgaggcagactcctaatatggctagaactattcttactaaggttttaaattctgcaagggatgagaactaacccctgaagagggaatctggagaccatcctttctaagtcttgactggaatatgggctaatttttggattcttgcagctttttgtttgacgacctttccgttgtcatcgatttttagacagcaattagttaggctgaactttctacatactcctccctcttgggctaggaggtagtctaaagccagtctattttgataaacggcatttctcatttctgtagatttccgagccagcaaatttaaggctcttgcagtatcattcgtaatgatctccagtactgcctgcaaccatatgatgtgatttagcatgtaaataggggtgcggtatctccatgatccatctgcccatgtggctgggccatagtattgcattattctttcaggtggccattcattatctttaattctttatggttattccccttttatttcttttgacctgacatgaacctccaactaggttctaggtaaggactttgggtcataacatatataaggctggccacttcctgggttgcagattgagtaggttatctggttgtgcgtacaagttcctcaatgggtccctgcatacctataataagtggtagaacagggttctagtcatggtgcttcctgtctacgtattgtcagtgcagtgggggcatccttctaaggattctccctttaacgtggttaaagggaatagcaaaagtaatgaataacatgtttatacctagcatggagagaagaggtcctttcctagaggaggaggttgagcaaagcaacaggacaatagtaaaacaattaatattacaaggaaagtttccagacgtaagatttctaaccacttttactttcctgatgatgcctcgagctttggccgtacatagacgagtcagcttctggggtgactagaacagggctgttgtttcctcaagcttccaccgtgtgtagactggtcagcttctgaagtgaccagagcagggctgttgtagtcttcattggcacctcggtcccatcataggatcagctgggttggatggcctgggtccttctggctggtccacttgtcctgggctaccagtttcagccaactgtggtgaatccaaggcacgattcctgcaactttagcagcagtgagtagacaagattacaatatggggcccatcccatatgggtcccagtgttgttggattccattttttaaactaaacagagtccccgggtctaaagggataaattgggtctgtgaggcttatgggcattctttcccatacccagccatgaattttttgcatggctattcttaaagcctgcatctctctccttaaggctaattcctctagttcacagagatcacctttaaattggccgaacaagatctcataggtgaatacccagtttgtttggtgggggtgtacctcacttggaggaggaccatgggcaggacctgatcccaccttagatgagtttcttggcaaaatttttttagtagctgtttgagtgtctggttcatgtgttccactttttctgagctctgtggccagtaggctatgtgtaacttccactttattttcaataactgtgttagttcttgaactatcttggctatgaatgctggtccattgtctgacgctagagtcaggggcagtcgaaatccagggataatgtctcttaacagtactttagttacttctcgtgctttctcagtcctgatggggaaagccttgacccatcctgaaaaggtgcagacaagtactaacatgtttcaatatccccctgcttggggcaacccataagcagattttcacaaggtgtggcccctatttcctgcattcccagggtcctggtgggcccctgtattaggttgttctgggcacaagttaggcattgttcacaaatggctcatgtgatggcagtgagccgtggcacatagaagtggtgtcctaatagcgtctctagtgccgtttttcccatgtgagttccttggtggaattgcctcacaaatttggaggccaccatttcagggatggctagtctcacattagataatttccaccatcctccttcaatatgttctccagattcttgggcaaaccaggccctgtcacttagagagtaactccgggtctcctggaggggagattgcgggaggagaggcatggtcagggcttcttttctagagtgtggagcagtcaatgctgtctgtcttgcttctctgtctgcttttccatttcccttggcctcctgtgtccctgacttctggtgtcctttatagtgcataacagctaccttctctggggctcatacagcatctaagagctgtataatttcttctttgtatttatttctttgcccctggcagttaaaactcctccttatatatagcaatgtggcaaaagcatatttggaatcagtataaatattgatctttttgtcctttgctagcaaaagggctcttgttagagctatcagctctgctttttgggctgaagtttctgtgggcagagactgagcttccaccaccaagtgcaatgttactactgcatacccggcccattggactccttccagtacaaaactgcttctatctgtaaagtactcgatatctgggtccctgaggggttggtctgtaagatctctccagcttgagaatacctcatcaactgtgtctatacagcaatgaagagggcctcctggttctgattgaattgggagcaaaatagctgggtttagagtgttcacagtctctagagttacgtgaggatttttacatagaagcccttgataccaactcattattggatttgataaccaatggtgccctctctgatcgactaatgttataactcagtgcgatactcaggtggttagttgctgtcctagagttagtttgtcagcttcccatgccagtagggctgtggcagctaatgctttgaagcatgggggccatcccagcgccatggagtccaactgcctggataagtatgccaccaggcgatgccatgatcccgtgacctgagttaggactcctatagccattccctttcactcatgggcctatagaaagaaaggcttagttagacctggcagtcctaaggctggagccctagttaaggcttctttgatttgtttaaatgccttttcctggtctgcctcccagaggagggacttcttccctgcctcccccacttctaatgtgaccatgggctcctgggggcctagggagaaggaacccggttggtcctagtcctcatattcttaattctctgccagcccgatcaggtcggcatctggctccctcagggtgtggcagcccttggctgggggcctctttgtttcatagcctttgccattctcttcattgtcctctggacattcatttttctagtgtcccttctttttgcactgcacacattgacctccccttagcctcagccatctcttggctcgctgttcaacttggcctcttccatgcccacacccatgtgaacattcgcgtccctttacaatgttaattttcctttttgtgagggctgccgctaacaggttggcctttttcctaagcctctgctctgtttccttttttgcctcttggtcacagttaatgtacacctcggtggccacttctataagctgggtggcattcatgcctgcaaaaccctctagcttttgcagcttctctctgatgtcaccctgggcttgccttacaaatgctgcattcaccatgcactgattttcagcagcctcagggtcaaatggagtgtaaaactaaaatgcctcacagagtctctcataaaactggctagggctcccatcaattcgctggagtacttcagagaccttccttatattgattgccttttttccaccttccctcaatcattgcagctgtgcttcttagtacctttgcaggcgctgaagctgggttgcgtcatttgggtcccagttgggatctgtttctgggaattggccctgagcatatgcctggacattaagggtgccttcaggcacactggcttctagccagcagagagctgcctgggctatcctttgacactccttcgtgttaaacagcgttaggaggagattcctgcaatctggccaggttggattgtgcattaggaagatagactgcattagatctatgaggtcctgggggttctccgtgtaggagggggtatgatgtttccagtttaggagattagtggtagaaaaaggctggtaaataaaagtctgttgccccccttggacctggccctgttcatcataataaataggtccctgtgttttctggaggggcatctgcaaagctctggtgtgggcaaattgaaggtggcctgcttgatcatcttgacttccttcttcacctcctgggacaggggctcagatttgcccctttagggtgtagcctggggcatgataccatctgagttgggctgctcagtggccagccttggtaaaggtgggtagattggtgcatagggagggggggtttctatctcctccggtggttcctccaaaactggtttctcctgtctttcctgtggctttccctttgtctctgtagcttccagcaaagctgatttttttttggtggcttaggctcagcttgagcaaaaagctgccaggcaagtctgcaaccatgcaggtcgagtctgtactatatttaaccatgagtcaatacaagggaactggtctaggtgccctgactgtcctctgaccccagttaccaccttaaatacatagccaattgtttccttatctacatttccttcagctggccatctaacatcaaaagagggccattgtatttcacagagagttctcagcctctgggggtcaacttaattccatagtccccgaataacctttcttaaagttccttaacatacatgctaatcgggtgggttttggtgacttccctcccatttcctccccaatacagcacaacacattcattcttccttttgattcagaccaattaaaccatcccccttgcaggagttttcagacactgcttagctttggagtttgttaatcccctcacaattactaaattgtggggcacctccataagccgtatgtggattgccactagtcctggttggtcccacaattctctcagagcgcacagtctatactaagagacctgtagcccccacatgtcactgtctgcattggttcctcccaaaaccatctctttcacacacagtcacacaccgtcctactcccagttttctctcctaactgacttcgcgagccactcttatgccctagtcacttggggtgtaagtttccctgagtttgcaaaccattcttgcatcctgtgtcagtctactagttacaccttggaaggtgatcaggctccccttccatccttatgggacggttcctgccttgggccccaaaaccttaccgtggtcctgtagtgcactgttcctggaatcatcctgtagccccttagattctgttgtgctgtctgggaggggcattgggttgtgggatagctgatcccttcttcaggtttaagttctcctgagggcacctgaggtcatgggtctctcctggcttggggtctcacacctaaaggcaaagtagacagcaaacctgtcatctccatctcctggctggctcaccaaagtgttgcagaaaacaggaggcaggagaggccagtgggtgaaactagaggattttattaaggtgcacactggctcagtggattcacacacaaaaagctgagccctggacaagtacagggcttgtcttttatatgtgcatggtggccatctagtggcacaaggctcctggtgcaagcaagcaggctcacagaagcagaacaaaggcagttaattaaacagtgacaggttatgctgaccttgcagctgcattgggaggaaaacaggaagttaacaaactaaagctgaccttgcagctgcattgggaggaaaacaggaagttaacaaactaaagcaggccttgcagctggtatacgtcttactcaagctcgtcttgtgaccttgtcatgttgcccagaacagagaaactggagttgttgtgaagtaaccttgagtttcactaaggaaaaattactaaagagacagggaagctgggagaggaggaaaacttgtttttcacatccttgctctttgggagaagaggggctaaggactagttttctctacatcctctacttcagttttatgatggtgttcattattattttatttttaagcaaaattgactcattatagcatttctttttttttttttttttttgcagagtctcagaatgctcttaaactcttagtctctagtgttctgacagccttgacctcctaaaactaagattacaggcatgagccatggtgcctggtcaccatgtacctttttttgtagaactgtgctagtggtgatgaacatcttcaccttttattttggaaattctttattttcatcttctttttaaagggaagtaaatttaaatcaagtattattggttagaaatttttttttattacatcaaaatttgggaagttttcacccttttttatcttcaaataacctctgtattttttttcttcattttcttcttctaagatttcctaaatctagttgatggttatctaataagttgtttgttttgttttgtttttgtttttgtttttgttttttttgagatggagtctcgctctgtttcccaggctggagtgcagtggcacaatctcagctcatggcaaactctgtctcctgggttcatgccattctcttgcctcagcatcctgagtagctgggagtacaggtgcccgccaccacgcccagctatttttttatatttttgtagagactgggtttcaccatgttagccaggatgggcttgatctcctgacctcatgatctgcctgccttggcctcccaaggtatctaataagttttacattccatgttttaactttgttttgcaattatagatttttgtgttatatattttagggtatgccaccacacattcattaattgtgttttgattttttagtatttattataattatgcatgctaatttttaacatcttataatttaaggcagtgtggaagaaagtcaaatatgaatgagctatacgtctttttccaatagaattat

SEQ ID NO: 254 - DNA, 18034 bp, Homo sapiens
gcaatgtaaggtattatttgcttctatatttggattagttttattttgttcaaaaatagcaaacatttaaaacaaaaaattgtcagtagtttcttttaaaagcttatccattaaaggtttctcattagcatctcctgtttatgattgtatttccttttctctgaaattttattgccatacaatagatatcagtaatttaaaatgcctgccttccgggaatgcacagttacagtcaaacattgcagttatctagacaaattatttgttaatgtacattgatgttgccaactagattttatgagtaaacatttattattgtcttgtagttctatattgtggttttttactataaatttcttaatatcagtttattgtgtttttggttttacttatgtattataattttagataattggcaattctgtttgtatactttaagttaatgtggggtttaattaaaagataaatgggccatatgtctatcacaatcagatatgtgtgtgtttatatctgcaaatgtgaccccaatttttgttgtagcttaccttgtatatattctttcttagctcattctctttttctctttttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggcctggcaaattttgtatttttctttattagagacggggtttctccatgttggttaggctggtctcggattcctgacctcaggtgatctgcccacctcagcatctcaaagtgctgggattgcaggcattagccactgggcccgacctcttagctcattttcaatgttggttttatcttgtctaagtgagtagccttggaaatagtctcattttcgtcatgtgtttaatgatgaatatgtatttcctttgtgtgagacaaacactttgtgatttggaggtaatttttaaaaagatttataatttggtatttttttcagttttttaaaaagtaactgtaaaaacatgtaacatgtaatttagtttcttaaatctatttaaatatacatgtcacagccaggcatagtggtggctcacatctgtaaaaccaggattttgagaggccaggacagaaggattgcttgagcccaaaagattgagaccagcctgggcaaaatgtggagacaccctctctacaaacattttttttctaagaaatagccaggcagggttgtgtgtacctgtggtctcagctacttgagagaatgaggggcagggttacttgagcctgggactgtgaggctgcagtgagccataattgtgccacgcactcaagcttgggtgacagattgagaccctgtctcaaaaaaaaaaaaaaaaagttgtgtatttcaggtatgttaactatattcacattgttatgcaaaagacttctagaaattttatatcttgtaaaactaagactcaatatccattaaataacatttactcattttatgctctctccatcccttaacaaacacccttccactttctgtttttatgagtgtgactattttatatatcttacgtaagtgaaatcataatatctatgattttactactggctgatttcagttgacataatattttcaaagtgtatctttaaatgtgtcaagatttttaagattttttttaaggctgaataatattccattgtatcaaatatgtcttgaaggtcctatattgcatattttagatatagattaataaatggaattgctgtatttgataataattttatttttaattataagaagtacatttataacataaaataatggatgcctgcttgttttctactgacaatcaacacgggtttcttttttttttgagacagagtctcactctgttgcccaggctggagtgcagtggcatgatctcagctcactgcaacctctgcctcccaggttcaagcgattctcctgcctcagcctcctgagtagctgggattacaggcacgtgccaccacacccggctaatttttgtatttttagtagagatggggtttcaccatgttagtcaatctggtctggaactcctgaccttgtgatctgctcacctcggcctcccaacatgctgggattacaggcgtgagccaccgtgccagccagtccaacatgatgaaaccccatctctactaaaaatataaaaattggccaggcattgtggcaggcgcctgtaatcccagcttcttgggaagatgaggcaggagaattggttgaacctggaaggcggaggttgcagcaagctgagaccatgccactgcattccagcctgggcaacagagcaagactccatttcaaaataaaaaaaaaaaaaagaagttatcttctatgtctaattaaaagatttttcacttatggtttcaggaaataatcgaacttaattttatcagtattgatattcagtatggataattcagtatggatattcagttttaaaattatcttttttctattgtgtgctcatgtcaattttgtgggagattatttggccatattcagaagggttatttctgggctctctgttctttcatctgtttatctgtctttttgtcagtaccacattgtgtttgttattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgtctaccactgtaagttgtattgacatctttgaaaaactattattttttgattcctgagcaaacatatgttgaagagtgtgttttattttcttatatttttggattttttttagttttaatttatagcttaattcagttttggtcagaaaacacagtgtataattttggtcttcttaaatatatttgttgttgttgttgtgtttgttgtttttgtttggagacaggatcttactctgtcaaccaggctggagtgtactgccatgattttgcctcactgcagcctcaacctaccaggttcaagtgatctttcctcctcagtgtctcatgtagttgggactacaaacataaagtaccatgtctgaataattctttgattatttgtagggatagagtctcactatgttgcccaggctggcctcaaacttttaactccaagtgatcctcctaccttgatctctaagtgttgggattataggcgtgagctacaccacccagctggcattcttaaatttaataaaacttagtatgtgtcctaacagaatacaccagatgcaaataagaatattgtatattctcttgcttttgactggaaagttttgtactcatgtgttaaacctagttggtctgtaacatggttttgatgttcatgttctccaaaccttattctgcagtgtaatccttaatgttggatgtgagacctggtgggaggtgtttgggtcatgggagcaaagtcttcataaatagctggtaatcaaaatgtttacactccattaattcaaatgtaagcaggtttattagaagaacctggctccttcacctcatacttgctctgtctgttattatgtgacatgtacagttactcttcgccttcaaccatgattgtaagcttgctgagacactcaccagaagcagatgctggcacacactttttgtacagtctgctggattgtgagccatataatctttatttctttataaattatccactcaggtactcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaattgtagttactattttcataaaatgtagttgttttttttttcgctctgtggttttcagcctatttgacttagtgctgaaatgattcccttgtaggcaacatactgtttgcttttttcttaagctagtaaagcattttattttttctttttataatttcatttatttacttgtttattcatttatttttgagatagggtctcactctgtcaaccaggctagtttgcagtgttgtgatcatggctcactgcagcctcaacttacaaactcagaagattctctcatttcagcctcttaggtagctgggttacaagtgtgtagcatcacgcctagccagttttttgtgtatttttggttgagacagagttttgccacactgtcaaggctgttctcaatcttctgagatccagtgatcagcccgccttaacctcccaaagtcctgagattacatttctttttattaagtaatttaatttatatttaaaactgcttcttaaaaatgaagttattggttttattgtaactgttttatgtgttcctgagtggtatgttttttcttattcactgttttattgccttaaattttattttaattgtgtagtgatgtgcttcaattatttttctaattttgttttgcacagtttctttaattattatctttataatcatgttgtctattcatgtgttttcatgctgctgataaaaacgtaccttaccctgggcaaattacagaagaaagaagtttattggacttacagtttcatgtgattgaagagacctcacaatcatggtggaaggtgaaaggcatgtctcacatggtggcagacagagagcttgtgcagaaaaactctgccttataaagccatcagatttcatgagacttattcactatcatgagactagtacagaagagacctgcccccatgattcaattaccttccaccacatccctcccacaacatgtgggaattaaagatgagacttgggttgggacacagccaaaccatattattttaaaaaatggagtttacattaaatatcttaaaattcaaacaatatactttaatgacaacttcaattgaatataaaattatacctctatgtttttcagtttgttattaacattaaaaatttttagactgggtgcagtggctcacgcctgtaatcccaacactttgggaggccgaggtgggcggataacctgaggtcaggagtttgaaaccagcctgaccaacatggagaaaccctgtctctactaaataatacaaaattagccaggcatggtggtgcatgcctgtaatcccagctactcgggaggctgaggcaggagaattgcctgaacccgggagggagaggttgcagtgagccaagattgtgccattgcactccagcctgggcaacaagtgcgatactccatctcaaaataaaataaataaatataaattattttgtgtatttattaacatatttatgcagattgtattctgttttaaatattttacagaggagctttaagggttttatgcatcattattatgatagtaaagacttctatatttgtatatttacatttaatatagacttttattttatatgtggttttgttagagaaaataggaggcaggagacacccagtaggtgaaactggaggattttattaaggtgcaccctggcacaatggattcgcatccaaaaagctgagccttggactaagacagggcttgtcttttatacatgcatgggccatctagtggcgcaaagctcgtggtgcaagtaagcaggctcacagaagcagaacagaggcagttaatcaaacagtgacaggttatgctgaccttgcagcttcactggaagggaaacatgaatttatcaaactaaagcaggccttgcagctggtacatgtcttactcaagctcgtcttgtaaccttgtcatgttatccagaacagagaaactggagttgttgtgaagtaaccttgagtttcactaaggaaggattactaaggggaggaggaagctaggagaggaggaaaaattgtttttcccatcattgctctatgggaggagaggggataaggactagttttctttacatcctctacttcatttccccctttgacgctttttataaatgacgtttaatagcatcactatgacttaatttttcatgaaaaggcaagttttcttcatttggcaaaggctgatatttagttagggtcattagttgtgtagtagtttgcctggttacaagagcctctgtggccatttagatgtttttgacaaggaggggtaagagacaagggagtatgaggcagactcctaatatggctagaactattcttactaaggttttaaattctgcaagggatgagaactaacccctgaagagggaatctggagaccatcctttctaagtcttgactggaatatgggctaatttttggattcttgcagctttttgtttgacgacctttccgttgtcatcgatttttagacagcaattagttaggctgaactttctacatactcctccctcttgggctaggaggtagtctaaagccagtctattttgataaacggcatttctcatttctgtagatttccgagccagcaaatttaaggctcttgcagtatcattcgtaatgatctccagtactgcctgcaaccatatgatgtgatttagcatgtaaataggggtgcggtatctccatgatccatctgcccatgtggctgggccatagtattgcattattctttcaggtggccattcattatctttaattctttatggttattccccttttatttcttttgacctgacatgaacctccaactaggttctaggtaaggactttgggtcataacatatataaggctggccacttcctgggttgcagattgagtaggttatctggttgtgcgtacaagttcctcaatgggtccctgcatacctataataagtggtagaacagggttctagtcatggtgcttcctgtctacgtattgtcagtgcagtgggggcatccttctaaggattctccctttaacgtggttaaagggaatagcaaaagtaatgaataacatgtttatacctagcatggagagaagaggtcctttcctagaggaggaggttgagcaaagcaacaggacaatagtaaaacaattaatattacaaggaaagtttccagacgtaagatttctaaccacttttactttcctgatgatgcctcgagctttggccgtacatagacgagtcagcttctggggtgactagaacagggctgttgtttcctcaagcttccaccgtgtgtagactggtcagcttctgaagtgaccagagcagggctgttgtagtcttcattggcacctcggtcccatcataggatcagctgggttggatggcctgggtccttctggctggtccacttgtcctgggctaccagtttcagccaactgtggtgaatccaaggcacgattcctgcaactttagcagcagtgagtagacaagattacaatatggggcccatcccatatgggtcccagtgttgttggattccattttttaaactaaacagagtccccgggtctaaagggataaattgggtctgtgaggcttatgggcattctttcccatacccagccatgaattttttgcatggctattcttaaagcctgcatctctctccttaaggctaattcctctagttcacagagatcacctttaaattggccgaacaagatctcataggtgaatacccagtttgtttggtgggggtgtacctcacttggaggaggaccatgggcaggacctgatcccaccttagatgagtttcttggcaaaatttttttagtagctgtttgagtgtctggttcatgtgttccactttttctgagctctgtggccagtaggctatgtgtaacttccactttattttcaataactgtgttagttcttgaactatcttggctatgaatgctggtccattgtctgacgctagagtcaggggcagtcgaaatccagggataatgtctcttaacagtactttagttacttctcgtgctttctcagtcctgatggggaaagccttgacccatcctgaaaaggtgcagacaagtactaacatgtttcaatatccccctgcttggggcaacccataagcagattttcacaaggtgtggcccctatttcctgcattcccagggtcctggtgggcccctgtattaggttgttctgggcacaagttaggcattgttcacaaatggctcatgtgatggcagtgagccgtggcacatagaagtggtgtcctaatagcgtctctagtgccgtttttcccatgtgagttccttggtggaattgcctcacaaatttggaggccaccatttcagggatggctagtctcacattagataatttccaccatcctccttcaatatgttctccagattcttgggcaaaccaggccctgtcacttagagagtaactccgggtctcctggaggggagattgcgggaggagaggcatggtcagggcttcttttctagagtgtggagcagtcaatgctgtctgtcttgcttctctgtctgcttttccatttcccttggcctcctgtgtccctgacttctggtgtcctttatagtgcataacagctaccttctctggggctcatacagcatctaagagctgtataatttcttctttgtatttatttctttgcccctggcagttaaaactcctccttatatatagcaatgtggcaaaagcatatttggaatcagtataaatattgatctttttgtcctttgctagcaaaagggctcttgttagagctatcagctctgctttttgggctgaagtttctgtgggcagagactgagcttccaccaccaagtgcaatgttactactgcatacccggcccattggactccttccagtacaaaactgcttctatctgtaaagtactcgatatctgggtccctgaggggttggtctgtaagatctctccagcttgagaatacctcatcaactgtgtctatacagcaatgaagagggcctcctggttctgattgaattgggagcaaaatagctgggtttagagtgttcacagtctctagagttacgtgaggatttttacatagaagcccttgataccaactcattattggatttgataaccaatggtgccctctctgatcgactaatgttataactcagtgcgatactcaggtggttagttgctgtcctagagttagtttgtcagcttcccatgccagtagggctgtggcagctaatgctttgaagcatgggggccatcccagcgccatggagtccaactgcctggataagtatgccaccaggcgatgccatgatcccgtgacctgagttaggactcctatagccattccctttcactcatgggcctatagaaagaaaggcttagttagacctggcagtcctaaggctggagccctagttaaggcttctttgatttgtttaaatgccttttcctggtctgcctcccagaggagggacttcttccctgcctcccccacttctaatgtgaccatgggctcctgggggcctagggagaaggaacccggttggtcctagtcctcatattcttaattctctgccagcccgatcaggtcggcatctggctccctcagggtgtggcagcccttggctgggggcctctttgtttcatagcctttgccattctcttcattgtcctctggacattcatttttctagtgtcccttctttttgcactgcacacattgacctccccttagcctcagccatctcttggctcgctgttcaacttggcctcttccatgcccacacccatgtgaacattcgcgtccctttacaatgttaattttcctttttgtgagggctgccgctaacaggttggcctttttcctaagcctctgctctgtttccttttttgcctcttggtcacagttaatgtacacctcggtggccacttctataagctgggtggcattcatgcctgcaaaaccctctagcttttgcagcttctctctgatgtcaccctgggcttgccttacaaatgctgcattcaccatgcactgattttcagcagcctcagggtcaaatggagtgtaaaactaaaatgcctcacagagtctctcataaaactggctagggctcccatcaattcgctggagtacttcagagaccttccttatattgattgccttttttccaccttccctcaatcattgcagctgtgcttcttagtacctttgcaggcgctgaagctgggttgcgtcatttgggtcccagttgggatctgtttctgggaattggccctgagcatatgcctggacattaagggtgccttcaggcacactggcttctagccagcagagagctgcctgggctatcctttgacactccttcgtgttaaacagcgttaggaggagattcctgcaatctggccaggttggattgtgcattaggaagatagactgcattagatctatgaggtcctgggggttctccgtgtaggagggggtatgatgtttccagtttaggagattagtggtagaaaaaggctggtaaataaaagtctgttgccccccttggacctggccctgttcatcataataaataggtccctgtgttttctggaggggcatctgcaaagctctggtgtgggcaaattgaaggtggcctgcttgatcatcttgacttccttcttcacctcctgggacaggggctcagatttgcccctttagggtgtagcctggggcatgataccatctgagttgggctgctcagtggccagccttggtaaaggtgggtagattggtgcatagggagggggggtttctatctcctccggtggttcctccaaaactggtttctcctgtctttcctgtggctttccctttgtctctgtagcttccagcaaagctgatttttttttggtggcttaggctcagcttgagcaaaaagctgccaggcaagtctgcaaccatgcaggtcgagtctgtactatatttaaccatgagtcaatacaagggaactggtctaggtgccctgactgtcctctgaccccagttaccaccttaaatacatagccaattgtttccttatctacatttccttcagctggccatctaacatcaaaagagggccattgtatttcacagagagttctcagcctctgggggtcaacttaattccatagtccccgaataacctttcttaaagttccttaacatacatgctaatcgggtgggttttggtgacttccctcccatttcctccccaatacagcacaacacattcattcttccttttgattcagaccaattaaaccatcccccttgcaggagttttcagacactgcttagctttggagtttgttaatcccctcacaattactaaattgtggggcacctccataagccgtatgtggattgccactagtcctggttggtcccacaattctctcagagcgcacagtctatactaagagacctgtagcccccacatgtcactgtctgcattggttcctcccaaaaccatctctttcacacacagtcacacaccgtcctactcccagttttctctcctaactgacttcgcgagccactcttatgccctagtcacttggggtgtaagtttccctgagtttgcaaaccattcttgcatcctgtgtcagtctactagttacaccttggaaggtgatcaggctccccttccatccttatgggacggttcctgccttgggccccaaaaccttaccgtggtcctgtagtgcactgttcctggaatcatcctgtagccccttagattctgttgtgctgtctgggaggggcattgggttgtgggatagctgatcccttcttcaggtttaagttctcctgagggcacctgaggtcatgggtctctcctggcttggggtctcacacctaaaggcaaagtagacagcaaacctgtcatctccatctcctggctggctcaccaaagtgttgcagaaaacaggaggcaggagaggccagtgggtgaaactagaggattttattaaggtgcacactggctcagtggattcacacacaaaaagctgagccctggacaagtacagggcttgtcttttatatgtgcatggtggccatctagtggcacaaggctcctggtgcaagcaagcaggctcacagaagcagaacaaaggcagttaattaaacagtgacaggttatgctgaccttgcagctgcattgggaggaaaacaggaagttaacaaactaaagctgaccttgcagctgcattgggaggaaaacaggaagttaacaaactaaagcaggccttgcagctggtatacgtcttactcaagctcgtcttgtgaccttgtcatgttgcccagaacagagaaactggagttgttgtgaagtaaccttgagtttcactaaggaaaaattactaaagagacagggaagctgggagaggaggaaaacttgtttttcacatccttgctctttgggagaagaggggctaaggactagttttctctacatcctctacttcagttttatgatggtgttcattattattttatttttaagcaaaattgactcattatagcatttctttttttttttttttttttgcagagtctcagaatgctcttaaactcttagtctctagtgttctgacagccttgacctcctaaaactaagattacaggcatgagccatggtgcctggtcaccatgtacctttttttgtagaactgtgctagtggtgatgaacatcttcaccttttattttggaaattctttattttcatcttctttttaaagggaagtaaatttaaatcaagtattattggttagaaatttttttttattacatcaaaatttgggaagttttcacccttttttatcttcaaataacctctgtattttttttcttcattttcttcttctaagatttcctaaatctagttgatggttatctaataagttgtttgttttgttttgtttttgtttttgtttttgttttttttgagatggagtctcgctctgtttcccaggctggagtgcagtggcacaatctcagctcatggcaaactctgtctcctgggttcatgccattctcttgcctcagcatcctgagtagctgggagtacaggtgcccgccaccacgcccagctatttttttatatttttgtagagactgggtttcaccatgttagccaggatgggcttgatctcctgacctcatgatctgcctgccttggcctcccaaggtatctaataagttttacattccatgttttaactttgttttgcaattatagatttttgtgttatatattttagggtatgccaccacacattcattaattgtgttttgattttttagtatttattataattatgcatgctaatttttaacatcttataatttaaggcagtgtggaagaaagtcaaatatgaatgagctatacgtctttttccaatagaattatctctgtgtttgttttcctgtatacaaaaataaatgttatccttgtattttttttctaacttgtatatttgttgtgtaggtttgttgtgaatggttttctaattctgcgtagatgagtcatcataaaattctctttttttttgagatggactcttgctcttcttgcccaggctggagtgtaatggcgcgatctcagctcactgcaacttctgcctcctgggttgaaatgattctagtgcctcagcctcctatgtagctgagattacaggcatgtgccaacatgcctggctaatatttttgtatttttagtagagacagggtttctccatgttggtcaggctggtcttgaactcccaacctcaggtgatctgcccgcctcagcttcccaatgtactgagattacaggtgtgagccaccatgctcagcccataaaatttttataatttcaacaacctatttatttgtaaatctatatgatttctgtgtgggagaaacacttttggatttgaatataatttaaaactatcataactctgtatctcttttagttattattgtttatttcttgtcaaaaaaaaacaaaatttaccacaaaatatttttaaatatttagtcatatcaattatcttgacattgtcatgcaacatattgctagaatgtttttatcttgcaaagctaaatcttaacacatattaaacaacaagtactaatttttaattttttctttttttcttttttctttttttttttgagctggagtcttactctgctactcaggctggagtgctgtggcatgattcacctcactgcaacttccacctcccgggttcaagcaattctcacgcctcagcctcctgaatagctggaattacaggtgcccatcaccatgcctggctaatttttgcatttttagtaaagatgcagtttcaccatgttggccagcgtggtttcaaactcctgaccttaggtaatctatctgcctcagcctttcaaagtgctgggattacaggtatgggccaccatgcctggccacaattttttctgttttatagcgttttgcaaacaccactctgttttttgtttttaacagtataactacttcatgtatgtcataaaatctgtgtctttttgtgattggctcatttcattttgcataatgccatcaagatttatatttatagttggtagaatatttcctgcttttgaatactgagtatattccagaatatatatatatattttttgagacagtcttgccctgtcacctaggctggagtgcagtggggcgatcttggctcactgcaacctctgcctcctgggttcaagcaattcttttgcctcagcctcccgagtagctgggattacaggcacgtgccaacacgtttggctaatttttgtattttttttttcagtaaggacagggttcaccattgttggtctggttgatctcgaactccttaccttgtgatctgcctgccttggcctcccaaagtgctgggattacaggtgtgaaccaccgtgcctgggaagaatttttatatttcaaattatatctactgaatgatttattgaaagatatttgcattgcttttacctatttgcttacagtaacaatgctgcagcttttccgcgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacactacatctataaaaggaaaagtgatggcatctatatcataaatctcaagaggacctgggagaagcttctgctggcagctcgtgctattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttctgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctccctctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaaaaaaaaaaaaaatgctgcaataattatgagtctataaatgactacttatatgaccatatatgtgaaagtttatatatgtgctgcattctattttattagtctactttttcacctttatactcatatcaaattgtttaatttggtagctttgtaatgtgttttgaatcaggcactttaatgcctgcagcattctttctttctttttttttttttaatattgttgggtagtttgtttttcttttgagtctctgtatacttttgaggttggtgtttctatttcttcaaaaatgcaatgagaaatttgaaaaatattgcattaaatctgtagattgcattgagcaggatggactctgcaatattaagtatttcaacctttgtgtaagagcacactcaagagtgtgttgtttagtttctatatatttgtaaatttttcagttttttttttttgcttttatcgttgtatattctcattccattttggtcatagaatgtagttcatagaaatttacttttaaaaaatttgataagacttcctttttgtcctaagatgtggtctttcaagggaaatgttgtatgagctattgagaagggtgtgtattctgatgttgttgaggagtgttctccataactctgtttggaataattgttttatactgcctttaagtagtctgttcttttattaacattctttcttgttttagttttattacaaaaagtgtggtattaaaatatattgttctaattatattgctttctgtgtgtttcttccattctgtcaatatttgctttatatacttggaaccctaatgtgagacacacacacacacacacacacacacacacacaaatttgtcatagattccctgtgaatgaatctattattttttgatgtccttctttgtttctttggagtttcaatttcaagcacattttataaaatattatactttctgacttaagatgtagcttgtgtgatattattttgactctttctgctcttatttgattaatgtttgcatggaatgtctacttccatcctgccacttacagtcttttttaattattagacttactgttattttattatgcattttatttgattattgcatctttgtgtcttattctctttccatctttgtgtctttttgatgtttgcattgatatgctttcgcttatttatttatttatttgtttgagactgagttttactcttgttgtccatgctggagtgcaatggcattgatcttggctcaccgcaatctccgcctcctgggttcaagcaatttacctgcctcaacctcctgagtagctgagattacaggcaggtgccaccatgcctggctaattttgtatttttagtagatatgaggtttctccatgttggtcaggctagtcttgaactcctgacttcaggtgatccacccgcctcggcctcccaaagtgctggaattacaggcataagccaccatgcccaacctcttttgtgtatttatacaaatatttttgtggtaccttggggactacatataatgtctaaaagatacaacaatacattttaatctggtagaaaaacaggttgcatacaaaaattcttctttattacatcttccctcaaatttgtcattgatgttgctaattatatcttatgttgtatgttcattaactgatgtttataatgatttctattcttttattgttcaaatttcagagaataat

SEQ ID NO: 255 - DNA, 4161 bp, Homo sapiens
gcaatgtaaggtattatttgcttctatatttggattagttttattttgttcaaaaatagcaaacatttaaaacaaaaaattgtcagtagtttcttttaaaagcttatccattaaaggtttctcattagcatctcctgtttatgattgtatttccttttctctgaaattttattgccatacaatagatatcagtaatttaaaatgcctgccttccgggaatgcacagttacagtcaaacattgcagttatctagacaaattatttgttaatgtacattgatgttgccaactagattttatgagtaaacatttattattgtcttgtagttctatattgtggttttttactataaatttcttaatatcagtttattgtgtttttggttttacttatgtattataattttagataattggcaattctgtttgtatactttaagttaatgtggggtttaattaaaagataaatgggccatatgtctatcacaatcagatatgtgtgtgtttatatctgcaaatgtgaccccaatttttgttgtagcttaccttgtatatattctttcttagctcattctctttttctctttttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggcctggcaaattttgtatttttctttattagagacggggtttctccatgttggttaggctggtctcggattcctgacctcaggtgatctgcccacctcagcatctcaaagtgctgggattgcaggcattagccactgggcccgacctcttagctcattttcaatgttggttttatcttgtctaagtgagtagccttggaaatagtctcattttcgtcatgtgtttaatgatgaatatgtatttcctttgtgtgagacaaacactttgtgatttggaggtaatttttaaaaagatttataatttggtatttttttcagttttttaaaaagtaactgtaaaaacatgtaacatgtaatttagtttcttaaatctatttaaatatacatgtcacagccaggcatagtggtggctcacatctgtaaaaccaggattttgagaggccaggacagaaggattgcttgagcccaaaagattgagaccagcctgggcaaaatgtggagacaccctctctacaaacattttttttctaagaaatagccaggcagggttgtgtgtacctgtggtctcagctacttgagagaatgaggggcagggttacttgagcctgggactgtgaggctgcagtgagccataattgtgccacgcactcaagcttgggtgacagattgagaccctgtctcaaaaaaaaaaaaaaaaagttgtgtatttcaggtatgttaactatattcacattgttatgcaaaagacttctagaaattttatatcttgtaaaactaagactcaatatccattaaataacatttactcattttatgctctctccatcccttaacaaacacccttccactttctgtttttatgagtgtgactattttatatatcttacgtaagtgaaatcataatatctatgattttactactggctgatttcagttgacataatattttcaaagtgtatctttaaatgtgtcaagatttttaagattttttttaaggctgaataatattccattgtatcaaatatgtcttgaaggtcctatattgcatattttagatatagattaataaatggaattgctgtatttgataataattttatttttaattataagaagtacatttataacataaaataatggatgcctgcttgttttctactgacaatcaacacgggtttcttttttttttgagacagagtctcactctgttgcccaggctggagtgcagtggcatgatctcagctcactgcaacctctgcctcccaggttcaagcgattctcctgcctcagcctcctgagtagctgggattacaggcacgtgccaccacacccggctaatttttgtatttttagtagagatggggtttcaccatgttagtcaatctggtctggaactcctgaccttgtgatctgctcacctcggcctcccaacatgctgggattacaggcgtgagccaccgtgccagccagtccaacatgatgaaaccccatctctactaaaaatataaaaattggccaggcattgtggcaggcgcctgtaatcccagcttcttgggaagatgaggcaggagaattggttgaacctggaaggcggaggttgcagcaagctgagaccatgccactgcattccagcctgggcaacagagcaagactccatttcaaaataaaaaaaaaaaaaagaagttatcttctatgtctaattaaaagatttttcacttatggtttcaggaaataatcgaacttaattttatcagtattgatattcagtatggataattcagtatggatattcagttttaaaattatcttttttctattgtgtgctcatgtcaattttgtgggagattatttggccatattcagaagggttatttctgggctctctgttctttcatctgtttatctgtctttttgtcagtaccacattgtgtttgttattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgtctaccactgtaagttgtattgacatctttgaaaaactattattttttgattcctgagcaaacatatgttgaagagtgtgttttattttcttatatttttggattttttttagttttaatttatagcttaattcagttttggtcagaaaacacagtgtataattttggtcttcttaaatatatttgttgttgttgttgtgtttgttgtttttgtttggagacaggatcttactctgtcaaccaggctggagtgtactgccatgattttgcctcactgcagcctcaacctaccaggttcaagtgatctttcctcctcagtgtctcatgtagttgggactacaaacataaagtaccatgtctgaataattctttgattatttgtagggatagagtctcactatgttgcccaggctggcctcaaacttttaactccaagtgatcctcctaccttgatctctaagtgttgggattataggcgtgagctacaccacccagctggcattcttaaatttaataaaacttagtatgtgtcctaacagaatacaccagatgcaaataagaatattgtatattctcttgcttttgactggaaagttttgtactcatgtgttaaacctagttggtctgtaacatggttttgatgttcatgttctccaaaccttattctgcagtgtaatccttaatgttggatgtgagacctggtgggaggtgtttgggtcatgggagcaaagtcttcataaatagctggtaatcaaaatgtttacactccattaattcaaatgtaagcaggtttattagaagaacctggctccttcacctcatacttgctctgtctgttattatgtgacatgtacagttactcttcgccttcaaccatgattgtaagcttgctgagacactcaccagaagcagatgctggcacacactttttgtacagtctgctggattgtgagccatataatctttatttctttataaattatccactcaggtactcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaatt

SEQ ID NO: 256 - DNA, 29023 bp, Homo sapiens
tttgaccttttcacattgctacctttctgtgagaggctacaggtttaaatagaatctgatggcagaatctctaagtgtaaacaagcatcttaggagtgagagatcaaggccacaaagtagccagagccctgagcacaactatagctacctggaaaatgtgatactagagtgttattgtccaaaagctagctaatcaggacaggagatccaggttctggagctccaccaggatagtttcattttctttttagaatcagcctgagtctctcctgctggcttattattggtccatcagcccagggtcactggaaatgctctcacaatcacccaggcatctgagacatttgagaatctccagaacaattgtgtcaggctgacaagagtggttaattttgcttctgtcttactgtaaaagaaatgaatcatctggtgtgtgttcctcccatcatacaagagatgtctttggttggtacccagatgagagtttctctggttccctggtacttgagtgaaaaacaaggaggaggtctggagactcaaacagataaattgattccatttcatatagtcattagaaaaatagatgaagcagtcatggtccctaccatgcaagaacttttagtcttgactatcaactggataaatgatttaattatgcatcatatggtgggtacaataaatagacatgtgcaaaaatatgggatatatttgcaccattttctttatattgttgagacttctgatgtctacacctgaacatatatttataaacaagagttattatttgcattttttagcttgctaagaacacttatttatcttctaaaaaactattttagaaaaccttaagagatttgttaaattgcttattagtatgtgatataaccttgagaggggagtggggtttaaaaagattaaaaattatacaaactctgagatttaattttttttttttttggtacacttaaaaaatgaaacagaactgaaaatactccccagtggcacaaaaaacagaattttacattagctctacaccctgtcccaaccctgatcagattcaccctttttgaagaccttatttaggtgtggccatactctggagtcttgtctcacagaactaactagaagagatcagagttttgggtgatgcatcctgttgcttttttagggttggtgctcatgattttctgaaacccaaaagcagataaatggaaaatataaaatatgatttatagggtcttaattaaaaaaattttttttaaaaccattgtttgcagagacattacatttagcaacttgttttctctccctgcagatatagttgttgattcacaaatcacaaaatagtaaatataaacacaacaaaaattcatctaaattatatgaaactctatctgtatccctctcatctgtctatatttatattctatacattttttaaaaaaaatcagtgacagccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaaaaaaaaatcagtgacagataaacagaagaagaaataaaaatgctgggttcttattctaaatccttggaattattgaacacagtataaactcacagggttttatcagaattaaataatgggtcatcacagtgctctgtaacgtcttattgagaacacagtacctgcttaataaacattgcattagtacatgtgtacatgttgttttctaaatgcagacttactcagaaattgctgctttctgttttctctgtaaactttaaagagccaggaaataatatgatactttaagataaagaatggttgtcttcatttgtatcaaaagtatttgtgttgtgacaagactgctgaatataagggactctgtcctgtgcctcatttttctttttcttttttttctttttggagacgagtcttgctctgtcgcccaggctggagtgcggtggcgccatttcggctcactgcaagctccgcctcctgggttcacggcattctcctgcctcagcctcctgagtagctgggactacaggcaaccgccaccacacccggctaatttttgtatttttagtagagatggggtttcaccgtgttagccaggatggtctcgatctcctgacctcgtgatccacctgtctcggcctcccaaagtgctgtgattacaggcgtgagccaccgcgtccggcctgtgcctcatttttctaaacagtgctaataatgagcccagagagagcgacatcagcactgacaggggacttctttaaaacacccatttatggaccctttccaaacccacagaatcgtattacatagagtggggccaaatttacgaagtgatttataagctcattaaagcttgagtagcaatgcttaggtaagtggttataagcccagacttctaattagaatcacatggccaatttgcagaactctcttgtgcccttttcacagtttgcttaatgttctgggtgaaagcatctatttgttttaattaagtgtctcatgtgactctaatttgccagaatcaagtatgacgagttcaagatacatttatgagagttaagtgccgcctttgcactaaagaggggtccaggaacctgttctgtttgggtttgttaaggacaggacagtgtggccaatatttctattactgtagcagaaattgctagtgtctgtagcagaggagagaacctgaggaccaaaaaaataaaaagcacacacacacacacacacacacacacacacacacacacacactttttttctttttttttaagatggagtttcactcttgttgcccaggctggagtgcaatggtgcaatctcggctcactgcaacctccacctcccgcgttcaagcgattctcctcccccagcctcctgagtagctgggattacaggcatgtgccaccacgccctgctaattttctatttttagtagagatggggtttcttcatgttggtcaggctggtctcgaactccctacctcaagtgatccacccacctcagcctcccaaagtgcaggattacaggcatgagccaccttgcccagctgcagagaaacttatagttcctaaatcatttctgttataaaggacagaaatgggtagagtttttctgtcttgggctttctgcctttaggtgtggtggtaagagatgaacatgtggtgctcaaagtttttaaggcatattctcaagatgcaggtataattagtccagaaaatgtcatctgagaaataattctagaggaggaggagaaagagaaaaaatgactttttttcagctaaacatttctgacatcaagagctgtgtccgctgtgcctcctggattgccatgtgcttagtatgtgcaaatctttacttctaaacttgtgttttttctccctaatgagtttttcttaactacttttataaatgcttgtgatagtcaagggtctctgaaaaatatttcgtttctatatatcacagacttctctacatcacgacttcttatatgccgtgcagaattctcaccatgaattcgtgatctgcaatattaaaaatgttgtctttggctgttgaacatggataggtgtggattatctatctgtctgtctatctatctatctatctatctatctatctatccttctttctttctttttttttttttttgagacggaacctcactctgtcgtccccgctggagtgaagtggcatgatctcggctcactgcagcctccacatcccgggttcaagcaattctcctgcctcagcttcctgagtagctgggattacaagcatgcatcatcacactcagctaatttttgtatttttagtagagacggggttttaccatgttggtcaggctggtctcaaactcctgaccacatgatccacccgcctcagcctcccaaagtgctgggattataggcatgagccacagcatccagcaatgatactctagatttctatggggaaaacctgggattcttagtaaagatggagaacatgtaatgttgaggttccttctgtgttcttaatggcattacaccattaagaaaatgctcatttaaacagaatggcatttattacccaaaaagttctgaaaaaagtggctgggtgatgtggcttatgcctgtaatcccaaaactttgggagactgaggtggatggatcatgaagacaggagattgagaccatcctggctaccacggtgaaaccccatccctacaaaaaatacaaaaaattagccaggcatggtggcacgtgctagtagtcccagctactagggaagctgaggcaggaaaatcacttgaaccttgaaggcagaggttgcagtgagccaagatcgcaccattgcactccaacctgggtgacagagcgagactgagtctcaaaaaaaaaaaaaaaaaaaaaaaattaccaggagatacctgcttatttgggtgctaaagagagactacttaaagtcactattaaaaattgtagaacatggaaaatatctctatcttggactttccatataaccgatgttttcttatggttaaattgagactgtaatttactttagtggggggccatatctcagtagtgatgctgtgtccttctgggtgcatcagcacactatgaaaacttgttcgagtgcatttgatgttaataactcacttgcttaataaactctcttacagatttttgcactatagaggttttttttcctcttcatcattaagtatctttatgcagctgatgtccatacaccatcacatttaatctggcagctgccctgtttttgaggttttctttgtatttatctttctttggtaaatgaaagctctcatctttgtttacaggccagaaaaactgaaaaagacacaggctcttccacttactggatgtttgacaaaatgatattttggggccaaaacattggcattactggtaaacttggtagagattcagtaactcagactttatttcagatctcctgaaaaaataatctgcattaacatgatgtccagtttattgtacacattaaaatttgagtggtaccttctaagtcaacatgtctattttgtctgaaaaatgtaaagaactatgtctttttcatctgaaaaacatatataactcattctgtattatgtaaatatagtactcaaaaatgtgcatgttagtgtctatgccctcaattttatactttatcatccagacaagtatcatatatacactgatgttgtggatattatgccactctcttttctcagagttagagaatacattagaaaaggtttgtgtgttgacaattattttattggataatttcagtcactcttataagtcagaaccagttttttttactctctcattttgccttgagtcaaatggaaaattctgccaatggccactttgtacatatgtgtgtttgtgtgtcttttccagggactcttgacgtttaggtatgtggccatagaattctctctggaggagtagcagtgcctggacactgcacagcagaatttatagaggaatgttatgaaaacctggccttcctgggtgaggataactttaatacaaaattccttatataaactaaaggtttcatttctcttttgtagaatgttttctggtaatttatgctttcaaatttctgttttcaagaaaatcctggggatttgtctgtttagaaaagaatttcttcaagatatttcatcttgacctgaactttccacattcctgagcggatctgtgtccttcactttagattattggtaatttcagaagtttagttgcataaaatattgttactcacaccttaaaatctaattatcatcaccagtttttgattcagtagtaccaggcagtgaaattaagaacctacaaaattaattttttttttttttggagatggagtcttgctctgtcacccaggctagagtacagtggcatgatctcggctcactgcaacttccgcctcccaggttcaagcgattctgcctcagcctactaagtagctgggattacaggcacccgccaccatgcccagctaatttttgtatttttagtagagacagggtttcaccatcttgggcaggctggtctcaaactcccgacctcgtgatcccagcctcccaaattgctgagattacaggcgtgagccactgcgcctgaccaataaaagtattttctaaatagttaaacatttctgttataaattagtatattgggataaatttattagaatattctattatatcctctttactgaacacattactaagttggtaattggagaatatgagcaagattcatgttagttatttttaataaaacaggtattactgtctctaagccagacctgatcacctatctggagcgagaaaaagagccctggaatatgaagtgacatgagatggtggatgaacccccaggtaggttagagtgaatacaacagacaacatggatgagaggcccaaatcaagaagaaagcaagtctttaaagtgatttgggaagctgtgttcaaaaggaaatagtttctggaaagcctgaaatttttaaaaattatactctcacgtaggggcatcttatgtcttatgtttataaaatttctaagaattctaatttcccttcagtgttcttccttcaaatttacagtgacagctaaagtactattcatgacatacaaaaagagtgcacaatctgacttttttcttgtttttgtggacagagagatatctccataattttgagatactctatgttaaactattttttaagttctctttttacatcacgtctgaaatgcacgagagtgacggtttctgtttcactggttttcttgttcattttttctgcacatttcatcctgttttcattaccatagttttgaaatatagtttgaaattataaagtatgatgtccttctgctttgttcttttttcttaagattgctttggctattcaaagtttattgtagtttcatctatgttttagggttgtgtttttcattactgtgaaaaaaaaacactggaattttgacagggagtttattgaatctagagatcactttggataatatggcagtttcacaatacttattctttcagtagaaataaaatatttttaaatttatttgtgtcctctaatttttttcattgatatatctttcacttaaaagatttacaagctccttgtttaaatttgttctaaaattaattatttcattgctattgtaaataagattttttttctctcttttatcagaccgtttgttttaagtgtatggaaccataacttatacttgtatgttaattttatatttttagtttaaacaagttttaatgtactgtttatgttttttttttatatataagattacatggtctaccaacagcaatgttttacttttggtcttcaatttcaatgactttaaatttttcttttgactatttcttcatccacatactttcagtgctatgttaaaatagaagcattgacaataagaaacaattgttttgcaatggggtctgtaaatttaaaggagcaaacacctcttcaagattttataaactggtttcagagagcaaaaataaatttttgtttggcccccccaatgtgatagaatgccctctgggtttgtggtgaagaagggttgtagcttggtcttaaggctgctgggtttgcacaagggttcacctttagttgtcttgttaaaaggggcttggataggctgggtgcggtggctcatgcctgtaatcccagcactgtgggaggccgaggcgggtggatcacgaggtcaggagatcaagaccatcctggctaactcggtgaaaccccgtctctactaaaaatacaaaaaaattagccgggcgtggtggcaggcgcctgtagtcccagctactcgggaggctgaggcaggagaatggcgtgaacctgggaggcagagcttgcagtgaaccgagatcgtgccactgcactccagcctgggtgacagagcgagactccctctccaaaaaaaaaaaaaaaaaaaaaaaaaagggaaaagggcttggatagttgtagttttcattttcatttaatttttggacagagtgaatatctttcaggactttgctgtgtattgcagacccaggggcaggtttctgcagtcgggtctgcatatggtgttctttatatcaggatgtgatgagagtggctttcactgagtacaagagagaattttcccaggtcactttgggtttctacataggcagaaccggccatgaactgtggctcagggagctggaaatgagtcatggaactgcctcagggaccacagtaaaggccaaggtctgcaggcctctcagcatagctataaatgggtgtcttcctctaggcctctggaagagcaggacctcccccagactgtgactgggaagagtttgggatggttacagagtaagttcagaattctcactggaaccaagttaggtggaacgttttcttgtctgtagccaacaacagtagtcctgtagtttgccacctgaatgagggcctgccttctaaacagaattatcttcaatattgggctttagcagagtttcacaactcccttcctggatctcagaactctcttaaaggcacttttttttttttttttttgagacggagtcttgctctgtcacacagactggagtgcagtggcgaatgcagtggcacgatcttgactcactgcaacctccggctcccaggttcaagtgattctcctgcctcagcctcccgagtagctgggattacaggtgcccgccaccacccagctaaattttgtgtttttagtagagattgggtttcaccaggttggctaggctggtcttgaacttttgacctcaggtgatccacccacctcagactcccaaattgttgggattacaggtgtaagccaatgtgcctggccaaaggcacttatttttgagatggggtcttgttacataacccaggcaagttttagtattttgactgtaagcaattctttaatgtatcatgtagctgtcattactggtgtaaaccatgatgcgtgattctcttaaaaaggcattttcatcaggaatgactgacaaattttcttgctgtcaggggataagcaaataggatgccttttttttttttatcttgttaatgtcactctccatataaatttttactttattttctactttaaatttgtctgcaattttagattcagacatttagggcaatatactagaatttacgtgttgtgcctgaattaaattaggtaattagtatgcaggcaggcaaaaaggaattataaaattttcaaccacttttgtcagcctatatctaaataataacatagtttatttcccaaatatttgttttatatatgaggctctaaccatattctgctaaatatatgtataatttagcaatgtaaggtattatttgcttctatatttggattagttttattttgttcaaaaatagcaaacatttaaaacaaaaaattgtcagtagtttcttttaaaagcttatccattaaaggtttctcattagcatctcctgtttatgattgtatttccttttctctgaaattttattgccatacaatagatatcagtaatttaaaatgcctgccttccgggaatgcacagttacagtcaaacattgcagttatctagacaaattatttgttaatgtacattgatgttgccaactagattttatgagtaaacatttattattgtcttgtagttctatattgtggttttttactataaatttcttaatatcagtttattgtgtttttggttttacttatgtattataattttagataattggcaattctgtttgtatactttaagttaatgtggggtttaattaaaagataaatgggccatatgtctatcacaatcagatatgtgtgtgtttatatctgcaaatgtgaccccaatttttgttgtagcttaccttgtatatattctttcttagctcattctctttttctctttttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggcctggcaaattttgtatttttctttattagagacggggtttctccatgttggttaggctggtctcggattcctgacctcaggtgatctgcccacctcagcatctcaaagtgctgggattgcaggcattagccactgggcccgacctcttagctcattttcaatgttggttttatcttgtctaagtgagtagccttggaaatagtctcattttcgtcatgtgtttaatgatgaatatgtatttcctttgtgtgagacaaacactttgtgatttggaggtaatttttaaaaagatttataatttggtatttttttcagttttttaaaaagtaactgtaaaaacatgtaacatgtaatttagtttcttaaatctatttaaatatacatgtcacagccaggcatagtggtggctcacatctgtaaaaccaggattttgagaggccaggacagaaggattgcttgagcccaaaagattgagaccagcctgggcaaaatgtggagacaccctctctacaaacattttttttctaagaaatagccaggcagggttgtgtgtacctgtggtctcagctacttgagagaatgaggggcagggttacttgagcctgggactgtgaggctgcagtgagccataattgtgccacgcactcaagcttgggtgacagattgagaccctgtctcaaaaaaaaaaaaaaaaagttgtgtatttcaggtatgttaactatattcacattgttatgcaaaagacttctagaaattttatatcttgtaaaactaagactcaatatccattaaataacatttactcattttatgctctctccatcccttaacaaacacccttccactttctgtttttatgagtgtgactattttatatatcttacgtaagtgaaatcataatatctatgattttactactggctgatttcagttgacataatattttcaaagtgtatctttaaatgtgtcaagatttttaagattttttttaaggctgaataatattccattgtatcaaatatgtcttgaaggtcctatattgcatattttagatatagattaataaatggaattgctgtatttgataataattttatttttaattataagaagtacatttataacataaaataatggatgcctgcttgttttctactgacaatcaacacgggtttcttttttttttgagacagagtctcactctgttgcccaggctggagtgcagtggcatgatctcagctcactgcaacctctgcctcccaggttcaagcgattctcctgcctcagcctcctgagtagctgggattacaggcacgtgccaccacacccggctaatttttgtatttttagtagagatggggtttcaccatgttagtcaatctggtctggaactcctgaccttgtgatctgctcacctcggcctcccaacatgctgggattacaggcgtgagccaccgtgccagccagtccaacatgatgaaaccccatctctactaaaaatataaaaattggccaggcattgtggcaggcgcctgtaatcccagcttcttgggaagatgaggcaggagaattggttgaacctggaaggcggaggttgcagcaagctgagaccatgccactgcattccagcctgggcaacagagcaagactccatttcaaaataaaaaaaaaaaaaagaagttatcttctatgtctaattaaaagatttttcacttatggtttcaggaaataatcgaacttaattttatcagtattgatattcagtatggataattcagtatggatattcagttttaaaattatcttttttctattgtgtgctcatgtcaattttgtgggagattatttggccatattcagaagggttatttctgggctctctgttctttcatctgtttatctgtctttttgtcagtaccacattgtgtttgttattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgtctaccactgtaagttgtattgacatctttgaaaaactattattttttgattcctgagcaaacatatgttgaagagtgtgttttattttcttatatttttggattttttttagttttaatttatagcttaattcagttttggtcagaaaacacagtgtataattttggtcttcttaaatatatttgttgttgttgttgtgtttgttgtttttgtttggagacaggatcttactctgtcaaccaggctggagtgtactgccatgattttgcctcactgcagcctcaacctaccaggttcaagtgatctttcctcctcagtgtctcatgtagttgggactacaaacataaagtaccatgtctgaataattctttgattatttgtagggatagagtctcactatgttgcccaggctggcctcaaacttttaactccaagtgatcctcctaccttgatctctaagtgttgggattataggcgtgagctacaccacccagctggcattcttaaatttaataaaacttagtatgtgtcctaacagaatacaccagatgcaaataagaatattgtatattctcttgcttttgactggaaagttttgtactcatgtgttaaacctagttggtctgtaacatggttttgatgttcatgttctccaaaccttattctgcagtgtaatccttaatgttggatgtgagacctggtgggaggtgtttgggtcatgggagcaaagtcttcataaatagctggtaatcaaaatgtttacactccattaattcaaatgtaagcaggtttattagaagaacctggctccttcacctcatacttgctctgtctgttattatgtgacatgtacagttactcttcgccttcaaccatgattgtaagcttgctgagacactcaccagaagcagatgctggcacacactttttgtacagtctgctggattgtgagccatataatctttatttctttataaattatccactcaggtactcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaattgtagttactattttcataaaatgtagttgttttttttttcgctctgtggttttcagcctatttgacttagtgctgaaatgattcccttgtaggcaacatactgtttgcttttttcttaagctagtaaagcattttattttttctttttataatttcatttatttacttgtttattcatttatttttgagatagggtctcactctgtcaaccaggctagtttgcagtgttgtgatcatggctcactgcagcctcaacttacaaactcagaagattctctcatttcagcctcttaggtagctgggttacaagtgtgtagcatcacgcctagccagttttttgtgtatttttggttgagacagagttttgccacactgtcaaggctgttctcaatcttctgagatccagtgatcagcccgccttaacctcccaaagtcctgagattacatttctttttattaagtaatttaatttatatttaaaactgcttcttaaaaatgaagttattggttttattgtaactgttttatgtgttcctgagtggtatgttttttcttattcactgttttattgccttaaattttattttaattgtgtagtgatgtgcttcaattatttttctaattttgttttgcacagtttctttaattattatctttataatcatgttgtctattcatgtgttttcatgctgctgataaaaacgtaccttaccctgggcaaattacagaagaaagaagtttattggacttacagtttcatgtgattgaagagacctcacaatcatggtggaaggtgaaaggcatgtctcacatggtggcagacagagagcttgtgcagaaaaactctgccttataaagccatcagatttcatgagacttattcactatcatgagactagtacagaagagacctgcccccatgattcaattaccttccaccacatccctcccacaacatgtgggaattaaagatgagacttgggttgggacacagccaaaccatattattttaaaaaatggagtttacattaaatatcttaaaattcaaacaatatactttaatgacaacttcaattgaatataaaattatacctctatgtttttcagtttgttattaacattaaaaatttttagactgggtgcagtggctcacgcctgtaatcccaacactttgggaggccgaggtgggcggataacctgaggtcaggagtttgaaaccagcctgaccaacatggagaaaccctgtctctactaaataatacaaaattagccaggcatggtggtgcatgcctgtaatcccagctactcgggaggctgaggcaggagaattgcctgaacccgggagggagaggttgcagtgagccaagattgtgccattgcactccagcctgggcaacaagtgcgatactccatctcaaaataaaataaataaatataaattattttgtgtatttattaacatatttatgcagattgtattctgttttaaatattttacagaggagctttaagggttttatgcatcattattatgatagtaaagacttctatatttgtatatttacatttaatatagacttttattttatatgtggttttgttagagaaaataggaggcaggagacacccagtaggtgaaactggaggattttattaaggtgcaccctggcacaatggattcgcatccaaaaagctgagccttggactaagacagggcttgtcttttatacatgcatgggccatctagtggcgcaaagctcgtggtgcaagtaagcaggctcacagaagcagaacagaggcagttaatcaaacagtgacaggttatgctgaccttgcagcttcactggaagggaaacatgaatttatcaaactaaagcaggccttgcagctggtacatgtcttactcaagctcgtcttgtaaccttgtcatgttatccagaacagagaaactggagttgttgtgaagtaaccttgagtttcactaaggaaggattactaaggggaggaggaagctaggagaggaggaaaaattgtttttcccatcattgctctatgggaggagaggggataaggactagttttctttacatcctctacttcatttccccctttgacgctttttataaatgacgtttaatagcatcactatgacttaatttttcatgaaaaggcaagttttcttcatttggcaaaggctgatatttagttagggtcattagttgtgtagtagtttgcctggttacaagagcctctgtggccatttagatgtttttgacaaggaggggtaagagacaagggagtatgaggcagactcctaatatggctagaactattcttactaaggttttaaattctgcaagggatgagaactaacccctgaagagggaatctggagaccatcctttctaagtcttgactggaatatgggctaatttttggattcttgcagctttttgtttgacgacctttccgttgtcatcgatttttagacagcaattagttaggctgaactttctacatactcctccctcttgggctaggaggtagtctaaagccagtctattttgataaacggcatttctcatttctgtagatttccgagccagcaaatttaaggctcttgcagtatcattcgtaatgatctccagtactgcctgcaaccatatgatgtgatttagcatgtaaataggggtgcggtatctccatgatccatctgcccatgtggctgggccatagtattgcattattctttcaggtggccattcattatctttaattctttatggttattccccttttatttcttttgacctgacatgaacctccaactaggttctaggtaaggactttgggtcataacatatataaggctggccacttcctgggttgcagattgagtaggttatctggttgtgcgtacaagttcctcaatgggtccctgcatacctataataagtggtagaacagggttctagtcatggtgcttcctgtctacgtattgtcagtgcagtgggggcatccttctaaggattctccctttaacgtggttaaagggaatagcaaaagtaatgaataacatgtttatacctagcatggagagaagaggtcctttcctagaggaggaggttgagcaaagcaacaggacaatagtaaaacaattaatattacaaggaaagtttccagacgtaagatttctaaccacttttactttcctgatgatgcctcgagctttggccgtacatagacgagtcagcttctggggtgactagaacagggctgttgtttcctcaagcttccaccgtgtgtagactggtcagcttctgaagtgaccagagcagggctgttgtagtcttcattggcacctcggtcccatcataggatcagctgggttggatggcctgggtccttctggctggtccacttgtcctgggctaccagtttcagccaactgtggtgaatccaaggcacgattcctgcaactttagcagcagtgagtagacaagattacaatatggggcccatcccatatgggtcccagtgttgttggattccattttttaaactaaacagagtccccgggtctaaagggataaattgggtctgtgaggcttatgggcattctttcccatacccagccatgaattttttgcatggctattcttaaagcctgcatctctctccttaaggctaattcctctagttcacagagatcacctttaaattggccgaacaagatctcataggtgaatacccagtttgtttggtgggggtgtacctcacttggaggaggaccatgggcaggacctgatcccaccttagatgagtttcttggcaaaatttttttagtagctgtttgagtgtctggttcatgtgttccactttttctgagctctgtggccagtaggctatgtgtaacttccactttattttcaataactgtgttagttcttgaactatcttggctatgaatgctggtccattgtctgacgctagagtcaggggcagtcgaaatccagggataatgtctcttaacagtactttagttacttctcgtgctttctcagtcctgatggggaaagccttgacccatcctgaaaaggtgcagacaagtactaacatgtttcaatatccccctgcttggggcaacccataagcagattttcacaaggtgtggcccctatttcctgcattcccagggtcctggtgggcccctgtattaggttgttctgggcacaagttaggcattgttcacaaatggctcatgtgatggcagtgagccgtggcacatagaagtggtgtcctaatagcgtctctagtgccgtttttcccatgtgagttccttggtggaattgcctcacaaatttggaggccaccatttcagggatggctagtctcacattagataatttccaccatcctccttcaatatgttctccagattcttgggcaaaccaggccctgtcacttagagagtaactccgggtctcctggaggggagattgcgggaggagaggcatggtcagggcttcttttctagagtgtggagcagtcaatgctgtctgtcttgcttctctgtctgcttttccatttcccttggcctcctgtgtccctgacttctggtgtcctttatagtgcataacagctaccttctctggggctcatacagcatctaagagctgtataatttcttctttgtatttatttctttgcccctggcagttaaaactcctccttatatatagcaatgtggcaaaagcatatttggaatcagtataaatattgatctttttgtcctttgctagcaaaagggctcttgttagagctatcagctctgctttttgggctgaagtttctgtgggcagagactgagcttccaccaccaagtgcaatgttactactgcatacccggcccattggactccttccagtacaaaactgcttctatctgtaaagtactcgatatctgggtccctgaggggttggtctgtaagatctctccagcttgagaatacctcatcaactgtgtctatacagcaatgaagagggcctcctggttctgattgaattgggagcaaaatagctgggtttagagtgttcacagtctctagagttacgtgaggatttttacatagaagcccttgataccaactcattattggatttgataaccaatggtgccctctctgatcgactaatgttataactcagtgcgatactcaggtggttagttgctgtcctagagttagtttgtcagcttcccatgccagtagggctgtggcagctaatgctttgaagcatgggggccatcccagcgccatggagtccaactgcctggataagtatgccaccaggcgatgccatgatcccgtgacctgagttaggactcctatagccattccctttcactcatgggcctatagaaagaaaggcttagttagacctggcagtcctaaggctggagccctagttaaggcttctttgatttgtttaaatgccttttcctggtctgcctcccagaggagggacttcttccctgcctcccccacttctaatgtgaccatgggctcctgggggcctagggagaaggaacccggttggtcctagtcctcatattcttaattctctgccagcccgatcaggtcggcatctggctccctcagggtgtggcagcccttggctgggggcctctttgtttcatagcctttgccattctcttcattgtcctctggacattcatttttctagtgtcccttctttttgcactgcacacattgacctccccttagcctcagccatctcttggctcgctgttcaacttggcctcttccatgcccacacccatgtgaacattcgcgtccctttacaatgttaattttcctttttgtgagggctgccgctaacaggttggcctttttcctaagcctctgctctgtttccttttttgcctcttggtcacagttaatgtacacctcggtggccacttctataagctgggtggcattcatgcctgcaaaaccctctagcttttgcagcttctctctgatgtcaccctgggcttgccttacaaatgctgcattcaccatgcactgattttcagcagcctcagggtcaaatggagtgtaaaactaaaatgcctcacagagtctctcataaaactggctagggctcccatcaattcgctggagtacttcagagaccttccttatattgattgccttttttccaccttccctcaatcattgcagctgtgcttcttagtacctttgcaggcgctgaagctgggttgcgtcatttgggtcccagttgggatctgtttctgggaattggccctgagcatatgcctggacattaagggtgccttcaggcacactggcttctagccagcagagagctgcctgggctatcctttgacactccttcgtgttaaacagcgttaggaggagattcctgcaatctggccaggttggattgtgcattaggaagatagactgcattagatctatgaggtcctgggggttctccgtgtaggagggggtatgatgtttccagtttaggagattagtggtagaaaaaggctggtaaataaaagtctgttgccccccttggacctggccctgttcatcataataaataggtccctgtgttttctggaggggcatctgcaaagctctggtgtgggcaaattgaaggtggcctgcttgatcatcttgacttccttcttcacctcctgggacaggggctcagatttgcccctttagggtgtagcctggggcatgataccatctgagttgggctgctcagtggccagccttggtaaaggtgggtagattggtgcatagggagggggggtttctatctcctccggtggttcctccaaaactggtttctcctgtctttcctgtggctttccctttgtctctgtagcttccagcaaagctgatttttttttggtggcttaggctcagcttgagcaaaaagctgccaggcaagtctgcaaccatgcaggtcgagtctgtactatatttaaccatgagtcaatacaagggaactggtctaggtgccctgactgtcctctgaccccagttaccaccttaaatacatagccaattgtttccttatctacatttccttcagctggccatctaacatcaaaagagggccattgtatttcacagagagttctcagcctctgggggtcaacttaattccatagtccccgaataacctttcttaaagttccttaacatacatgctaatcgggtgggttttggtgacttccctcccatttcctccccaatacagcacaacacattcattcttccttttgattcagaccaattaaaccatcccccttgcaggagttttcagacactgcttagctttggagtttgttaatcccctcacaattactaaattgtggggcacctccataagccgtatgtggattgccactagtcctggttggtcccacaattctctcagagcgcacagtctatactaagagacctgtagcccccacatgtcactgtctgcattggttcctcccaaaaccatctctttcacacacagtcacacaccgtcctactcccagttttctctcctaactgacttcgcgagccactcttatgccctagtcacttggggtgtaagtttccctgagtttgcaaaccattcttgcatcctgtgtcagtctactagttacaccttggaaggtgatcaggctccccttccatccttatgggacggttcctgccttgggccccaaaaccttaccgtggtcctgtagtgcactgttcctggaatcatcctgtagccccttagattctgttgtgctgtctgggaggggcattgggttgtgggatagctgatcccttcttcaggtttaagttctcctgagggcacctgaggtcatgggtctctcctggcttggggtctcacacctaaaggcaaagtagacagcaaacctgtcatctccatctcctggctggctcaccaaagtgttgcagaaaacaggaggcaggagaggccagtgggtgaaactagaggattttattaaggtgcacactggctcagtggattcacacacaaaaagctgagccctggacaagtacagggcttgtcttttatatgtgcatggtggccatctagtggcacaaggctcctggtgcaagcaagcaggctcacagaagcagaacaaaggcagttaattaaacagtgacaggttatgctgaccttgcagctgcattgggaggaaaacaggaagttaacaaactaaagctgaccttgcagctgcattgggaggaaaacaggaagttaacaaactaaagcaggccttgcagctggtatacgtcttactcaagctcgtcttgtgaccttgtcatgttgcccagaacagagaaactggagttgttgtgaagtaaccttgagtttcactaaggaaaaattactaaagagacagggaagctgggagaggaggaaaacttgtttttcacatccttgctctttgggagaagaggggctaaggactagttttctctacatcctctacttcagttttatgatggtgttcattattattttatttttaagcaaaattgactcattatagcatttctttttttttttttttttttgcagagtctcagaatgctcttaaactcttagtctctagtgttctgacagccttgacctcctaaaactaagattacaggcatgagccatggtgcctggtcaccatgtacctttttttgtagaactgtgctagtggtgatgaacatcttcaccttttattttggaaattctttattttcatcttctttttaaagggaagtaaatttaaatcaagtattattggttagaaatttttttttattacatcaaaatttgggaagttttcacccttttttatcttcaaataacctctgtattttttttcttcattttcttcttctaagatttcctaaatctagttgatggttatctaataagttgtttgttttgttttgtttttgtttttgtttttgttttttttgagatggagtctcgctctgtttcccaggctggagtgcagtggcacaatctcagctcatggcaaactctgtctcctgggttcatgccattctcttgcctcagcatcctgagtagctgggagtacaggtgcccgccaccacgcccagctatttttttatatttttgtagagactgggtttcaccatgttagccaggatgggcttgatctcctgacctcatgatctgcctgccttggcctcccaaggtatctaataagttttacattccatgttttaactttgttttgcaattatagatttttgtgttatatattttagggtatgccaccacacattcattaattgtgttttgattttttagtatttattataattatgcatgctaatttttaacatcttataatttaaggcagtgtggaagaaagtcaaatatgaatgagctatacgtctttttccaatagaattatctctgtgtttgttttcctgtatacaaaaataaatgttatccttgtattttttttctaacttgtatatttgttgtgtaggtttgttgtgaatggttttctaattctgcgtagatgagtcatcataaaattctctttttttttgagatggactcttgctcttcttgcccaggctggagtgtaatggcgcgatctcagctcactgcaacttctgcctcctgggttgaaatgattctagtgcctcagcctcctatgtagctgagattacaggcatgtgccaacatgcctggctaatatttttgtatttttagtagagacagggtttctccatgttggtcaggctggtcttgaactcccaacctcaggtgatctgcccgcctcagcttcccaatgtactgagattacaggtgtgagccaccatgctcagcccataaaatttttataatttcaacaacctatttatttgtaaatctatatgatttctgtgtgggagaaacacttttggatttgaatataatttaaaactatcataactctgtatctcttttagttattattgtttatttcttgtcaaaaaaaaacaaaatttaccacaaaatatttttaaatatttagtcatatcaattatcttgacattgtcatgcaacatattgctagaatgtttttatcttgcaaagctaaatcttaacacatattaaacaacaagtactaatttttaattttttctttttttcttttttctttttttttttgagctggagtcttactctgctactcaggctggagtgctgtggcatgattcacctcactgcaacttccacctcccgggttcaagcaattctcacgcctcagcctcctgaatagctggaattacaggtgcccatcaccatgcctggctaatttttgcatttttagtaaagatgcagtttcaccatgttggccagcgtggtttcaaactcctgaccttaggtaatctatctgcctcagcctttcaaagtgctgggattacaggtatgggccaccatgcctggccacaattttttctgttttatagcgttttgcaaacaccactctgttttttgtttttaacagtataactacttcatgtatgtcataaaatctgtgtctttttgtgattggctcatttcattttgcataatgccatcaagatttatatttatagttggtagaatatttcctgcttttgaatactgagtatattccagaatatatatatatattttttgagacagtcttgccctgtcacctaggctggagtgcagtggggcgatcttggctcactgcaacctctgcctcctgggttcaagcaattcttttgcctcagcctcccgagtagctgggattacaggcacgtgccaacacgtttggctaatttttgtattttttttttcagtaaggacagggttcaccattgttggtctggttgatctcgaactccttaccttgtgatctgcctgccttggcctcccaaagtgctgggattacaggtgtgaaccaccgtgcctgggaagaatttttatatttcaaattatatctactgaatgatttattgaaagatatttgcattgcttttacctatttgcttacagtaacaatgctgcagcttttccgcgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacactacatctataaaaggaaaagtgatggcatctatatcataaatctcaagaggacctgggagaagcttctgctggcagctcgtgctattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttctgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctccctctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaaaaaaaaaaaaaatgctgcaataattatgagtctataaatgactacttatatgaccatatatgtgaaagtttatatatgtgctgcattctattttattagtctactttttcacctttatactcatatcaaattgtttaatttggtagctttgtaatgtgttttgaatcaggcactttaatgcctgcagcattctttctttctttttttttttttaatattgttgggtagtttgtttttcttttgagtctctgtatacttttgaggttggtgtttctatttcttcaaaaatgcaatgagaaatttgaaaaatattgcattaaatctgtagattgcattgagcaggatggactctgcaatattaagtatttcaacctttgtgtaagagcacactcaagagtgtgttgtttagtttctatatatttgtaaatttttcagttttttttttttgcttttatcgttgtatattctcattccattttggtcatagaatgtagttcatagaaatttacttttaaaaaatttgataagacttcctttttgtcctaagatgtggtctttcaagggaaatgttgtatgagctattgagaagggtgtgtattctgatgttgttgaggagtgttctccataactctgtttggaataattgttttatactgcctttaagtagtctgttcttttattaacattctttcttgttttagttttattacaaaaagtgtggtattaaaatatattgttctaattatattgctttctgtgtgtttcttccattctgtcaatatttgctttatatacttggaaccctaatgtgagacacacacacacacacacacacacacacacacaaatttgtcatagattccctgtgaatgaatctattattttttgatgtccttctttgtttctttggagtttcaatttcaagcacattttataaaatattatactttctgacttaagatgtagcttgtgtgatattattttgactctttctgctcttatttgattaatgtttgcatggaatgtctacttccatcctgccacttacagtcttttttaattattagacttactgttattttattatgcattttatttgattattgcatctttgtgtcttattctctttccatctttgtgtctttttgatgtttgcattgatatgctttcgcttatttatttatttatttgtttgagactgagttttactcttgttgtccatgctggagtgcaatggcattgatcttggctcaccgcaatctccgcctcctgggttcaagcaatttacctgcctcaacctcctgagtagctgagattacaggcaggtgccaccatgcctggctaattttgtatttttagtagatatgaggtttctccatgttggtcaggctagtcttgaactcctgacttcaggtgatccacccgcctcggcctcccaaagtgctggaattacaggcataagccaccatgcccaacctcttttgtgtatttatacaaatatttttgtggtaccttggggactacatataatgtctaaaagatacaacaatacattttaatctggtagaaaaacaggttgcatacaaaaattcttctttattacatcttccctcaaatttgtcattgatgttgctaattatatcttatgttgtatgttcattaactgatgtttataatgatttctattcttttattgttcaaatttcagagaataattaaaaatgttttctgcgtcactaggataatgctaataaattctacaaagtgaatttgcatattttttctagaaaataatgtatttttatataattatgtgtagctttttgaatcatgttattttcagtaaaaggaactgttgttagcaccttttatatgtagggcatatgcagttccaatatacttttttagaatttcattactttggaaggttttttttttttatttggcaggatagattcactgatggtataattctcacttaataggtattttttttaacaactttttcatgactccataacatagttctttttttgagactaaacgtctctctatcccccagccaggctggagcatagtggtatgacttcaactcactgcaacctccacttcccaggttcaagtggttctccagcctcagcctcctgagtagctggtattacaggcatgtgccaccacacccagctaatttttgtcgttttggtagagacagggtttcaccatcttgtccaggctggccttgaactcctgacctcaggtgatccgtccacctctgcctcccaaagtgcctggattacaggcaggagccaccatgcctggcctggcacatcacttttatcttgcagcttcaaagataatctttttgtctttgactagaaattgtggttatatacatgtttgttataaatatctttctgtgatactagtttgttgtacttctttatttttacatcatattttcttttaggatctattagttttttttaaatttttttacctccacaatttttgtttttttgaaatcttaaatatttttgttcttgtcctcatttttctgaatttccatagttgtctctgttcctattttaatcaatgagaactattcaatttattaccaattattaaaagtaatttatacctctgattttttttatgctttctttcagaaaaatttataatatttttgctgggatcatattgccctattttgtatattttatctttgattgtgatttggacattaaaaaaagctacctgtcaaaatctttataatgttgttctgtcctggcatagtctgaaaacaattgttttggctggtgattatgggagtttctcacacatattcttaggatatgtgctgtctgaaattttgtgtttaatttttaattaacagagtttactcttgttattttgtaggagtcagaaatcacttgctacacctgttccttttctgtggtactgctgtcagtctgctgctctaccacttttttttttggtctcagctgactcaaactctcatttcaaaatatgccaccatttctttcagcacttt

SEQ ID NO: 257 - DNA, 6151 bp, Homo sapiens
acacgttcaccagggagattgagcctcagaaggcttggttcctgcccagggatccccagtgggcaggtggccgtccctaggttgggaggaggtttgtccacaggcacctgctctgtgctgctgcgatggggtctgcggtgtcctggcctgcaccgttggccttaacgggctagcatggctgtcatgtgtgtggccggcctcttcttcatccctgtcattggcctcactggcttccatgtggtgctggtcactcgggggcgcaccaccaacgagcaggtgcagaccccatgggggatgggtggccccaaagggccgagagagttggggctgcatggggacagggtgggggctggggcacccttgcctgaggtagcttgtgcagctgtgttgagacgaggctccaactctgagacccccacgtggggctacgcctgccccgtcccctgcgcacatcctgcctgtggacactgtggccaccagtgacccagaaatcccacagctccctgcaagttcaggctgggtaacctatgtgaggggcagccctgggctgatcccacctaagccacttcccgcaagtatcagcttctaaggaaccccagctcccttgcccagccccctgcccaccctggcctggaccttgggaggccaggctggctgagggtcctgcatccacaggtgactgggaagttccgcgggggtgtgaaccctttcacccgaggctgctgtgggaatgtggagcacgtgctgtgtagccccctggcgccccggtgaggcccggcctgggcagggtggaggggggcctctgctgggtgtggggcgggcagccttagaccctcttggtccgtttggctcttgccaggtatggccagccctgcccttgtgtgtttgtggcaggtgggctggctactgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaattccaccattagtcactctgtaaggcccacgggaagactttggaagaatttgagacgtgcttgagaaagcacatttctcttccctgagttgcatgagtgctctgtggtcactggaatggtgggcagtgcggggcggtctgtgcagtgatcaggaacaccaaacagtcccagggtgccatccttccttctgggccaccccgagaggcaggcctgtgactgggccctgtgcacctagaccagccccatccccagggacctctcccctcaggactgatgtctttcctggagagagtcactgggtgaagcagtgagtctgagcctccttggccaagggtctgagtctgcaggcatgtaggggccgtgcctcgcaggaggaggcatccctgtttggagatgagggctctgggtatgtcatcttcctgggactcctgggtccagtgggggattgggtctggttggccaagtgcattgagcccacatttgccctgatccacttctggctttgtggttcctgaggctcttgtcccaagcccaagcccaagcccatgcctatgtgcccgtcacaggggctagacgaggctcctcctccctctggctgccctgagtggtgggcccctggggctgcatggctccaagggcagaaccccaggtgtctgcagtagccagctgtggcctccctcctgttgcagagcccctgcccctcagccgtggatgctcagggacagggccatgggtcactatgtggctcttatggctccttgaggcccagttcctgaggccacggtgccatgtgtggcccccgtgggtgctgactggcggctgcaggcggggtggcaggtgggcagtggtgagaatgccttctccctacaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaacgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagaggtgggtgccgggaggtgcgggtgggcttcctggcacagggcagctgtccagccgtctccagggcccctcttggctgggcactcataggtcatcccaggggcctgagtttttctctggggacgggacagggaggatgcgcctcaccctgccttgaaggccttggctagcccgtgtggcccagctctgaggatgtcctgggcacgctctggggacagggtatgagaatttgtgtcctgagcccgacgactcgttcttctagagctggcacagacccagcatgtgggaggccatggggctttctctttggggccagtatcatgtggcagcctgggcctcctttaggctgtggctctggcttcctgggtcacagtggccctgtccacccagggctctccctgggcctgcttggctgcatctctaggaggctggggctgaggatattacctagcagcagaatgtgccaccctgagtggccgggccctggccctccctgtaggacatagttctaggaagcaggggcttccctgctcgtaggtggggaagctgaggactggagaaagcaggctggctccaggcacccggcaggttggtgactgagaaggcggggtcagctggctcacaggcccaggtccaggtaggagagctgcacacctgctggggccaggacccacgccacagacgcatggtgtcctcacggcatctgtcgccctgtccgggcctggaaacctcaagcacaggcgcagttgtttcccgtcggcagatgcagccccagagggagagcccagcccagcccagcccaggccacttggccacaaaggggctgagggcacagcagtccagccctgagcgggtctcctctaccccacagggtgggacctgttcagcttttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaactcggctgcactagtccacgtccgcgtcgtctctgtcttgctgcctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccacagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccc
